US 8,454,976 B2

(12) United States Patent
Shone et al.

(10) Patent No.: US 8,454,976 B2
(45) Date of Patent: *Jun. 4, 2013

(54) RECOMBINANT TOXIN FRAGMENTS

(75) Inventors: Clifford Charles Shone, Salisbury (GB); Conrad Padraig Quinn, Lilburn, GA (US); Keith Alan Foster, Salisbury (GB); John Chaddock, Salisbury (GB); Philip Marks, Salisbury (GB); John Sutton, Salisbury (GB); Patrick Stancombe, Salisbury (GB); Jonathan Wayne, Salisbury (GB)

(73) Assignees: Syntaxin Limited, Abingdon (GB); Health Protection Agency, Salisbury (GB)

( * ) Notice: Subject to any disclaimer, the term of this patent is extended or adjusted under 35 U.S.C. 154(b) by 1119 days.

This patent is subject to a terminal disclaimer.

(21) Appl. No.: 12/174,896

(22) Filed: Jul. 17, 2008

(65) Prior Publication Data

US 2009/0246827 A1  Oct. 1, 2009

Related U.S. Application Data

(63) Continuation of application No. 11/717,713, filed on Mar. 14, 2007, now Pat. No. 7,897,158, which is a continuation of application No. 10/241,596, filed on Sep. 12, 2002, now Pat. No. 7,192,596, which is a continuation-in-part of application No. 09/255,829, filed on Feb. 23, 1999, now Pat. No. 6,461,617, which is a continuation of application No. PCT/GB97/02273, filed on Aug. 22, 1997, which is a continuation-in-part of application No. 08/782,893, filed on Dec. 27, 1996, now abandoned.

(30) Foreign Application Priority Data

Aug. 23, 1996  (GB) .................................... 9617671.4
Dec. 13, 1996  (GB) .................................... 9625996.5

(51) Int. Cl.
| | |
|---|---|
| *A61K 39/40* | (2006.01) |
| *A61K 39/02* | (2006.01) |
| *A61K 39/08* | (2006.01) |
| *A61K 38/00* | (2006.01) |
| *C07K 14/00* | (2006.01) |
| *C07K 16/00* | (2006.01) |
| *C07K 17/00* | (2006.01) |
| *C07K 2/00* | (2006.01) |
| *C07K 4/00* | (2006.01) |
| *C07K 5/00* | (2006.01) |
| *C07K 7/00* | (2006.01) |

(52) U.S. Cl.
USPC .................. 424/247.1; 424/234.1; 424/236.1; 424/239.1; 424/167.1; 424/164.1; 530/300; 530/825

(58) Field of Classification Search
None
See application file for complete search history.

(56) References Cited

U.S. PATENT DOCUMENTS

| | | | |
|---|---|---|---|
| 4,594,336 | A | 6/1986 | Bizzini |
| 5,668,255 | A | 9/1997 | Murphy |
| 5,919,665 | A | 7/1999 | Williams |
| 5,989,545 | A | 11/1999 | Foster et al. |
| 6,043,042 | A | 3/2000 | Shone et al. |
| 6,372,225 | B1 | 4/2002 | Matsuda |
| 6,395,513 | B1 | 5/2002 | Foster et al. |
| 6,444,209 | B1 | 9/2002 | Johnson et al. |
| 6,461,617 | B1 | 10/2002 | Shone et al. |
| 6,632,440 | B1 | 10/2003 | Quinn et al. |
| 6,776,990 | B2 | 8/2004 | Sachs et al. |
| 6,787,517 | B1 | 9/2004 | Gil et al. |
| 6,822,076 | B2 | 11/2004 | Bigalke et al. |
| 6,962,703 | B2 | 11/2005 | Foster et al. |
| 7,081,529 | B2 | 7/2006 | Smith et al. |
| 7,132,259 | B1 * | 11/2006 | Dolly et al. .................. 435/69.1 |
| 7,192,596 | B2 | 3/2007 | Shone et al. |
| 7,193,066 | B1 | 3/2007 | Chaddock et al. |
| 7,368,532 | B2 | 5/2008 | Shone et al. |
| 7,419,676 | B2 | 9/2008 | Dolly et al. |
| 7,422,877 | B2 | 9/2008 | Dolly et al. |

(Continued)

FOREIGN PATENT DOCUMENTS

| | | |
|---|---|---|
| WO | 91/09871 | 7/1991 |
| WO | 92/15327 | 9/1992 |

(Continued)

OTHER PUBLICATIONS

Ho et al, Protein Science, 2012, 21:318-326.*

(Continued)

*Primary Examiner* — Nita M Minnifield
(74) *Attorney, Agent, or Firm* — Morris, Manning & Martin, LLP; Christopher W. Raimund

(57) ABSTRACT

A single polypeptide is provided which comprises first and second domains. The first domain enables the polypeptide to cleave one or more vesicle or plasma-membrane associated proteins essential to exocytosis, and the second domain enables the polypeptide to be translocated into a target cell or increases the solubility of the polypeptide, or both. The polypeptide thus combines useful properties of a clostridial toxin, such as a botulinum or tetanus toxin, without the toxicity associated with the natural molecule. The polypeptide can also contain a third domain that targets it to a specific cell, rendering the polypeptide useful in inhibition of exocytosis in target cells. Fusion proteins comprising the polypeptide, nucleic acids encoding the polypeptide and methods of making the polypeptide are also provided. Controlled activation of the polypeptide is possible and the polypeptide can be incorporated into vaccines and toxin assays.

18 Claims, 13 Drawing Sheets

U.S. PATENT DOCUMENTS

| | | | |
|---|---|---|---|
| 7,452,543 B2 | 11/2008 | Chaddock et al. | |
| 7,470,661 B2 | 12/2008 | Shone et al. | |
| 7,514,088 B2* | 4/2009 | Steward et al. | 424/239.1 |
| 7,674,470 B2* | 3/2010 | Shone et al. | 424/247.1 |
| 7,709,228 B2* | 5/2010 | Dolly et al. | 435/69.7 |
| 7,740,868 B2* | 6/2010 | Steward et al. | 424/239.1 |
| 7,749,517 B2* | 7/2010 | Young et al. | 424/246.1 |
| 7,811,584 B2* | 10/2010 | Steward et al. | 424/239.1 |
| 7,887,810 B2* | 2/2011 | Foster et al. | 424/183.1 |
| 7,892,560 B2* | 2/2011 | Foster et al. | 424/192.1 |
| 7,897,157 B2* | 3/2011 | Steward et al. | 424/239.1 |
| 7,897,158 B2* | 3/2011 | Shone et al. | 424/247.1 |
| 7,959,933 B2* | 6/2011 | Dolly et al. | 424/239.1 |
| 7,985,411 B2* | 7/2011 | Dolly et al. | 424/239.1 |
| 7,998,749 B2* | 8/2011 | Gilmore et al. | 436/172 |
| 8,012,479 B2* | 9/2011 | Shone et al. | 424/134.1 |
| 8,012,491 B2* | 9/2011 | Shone et al. | 424/247.1 |
| 8,017,134 B2* | 9/2011 | Shone et al. | 424/247.1 |
| 8,067,200 B2* | 11/2011 | Foster et al. | 435/69.1 |
| 8,124,074 B2* | 2/2012 | Foster et al. | 424/94.63 |
| 8,124,405 B2* | 2/2012 | Foster et al. | 435/320.1 |
| 8,158,132 B2* | 4/2012 | Foster et al. | 424/239.1 |
| 2004/0013687 A1 | 1/2004 | Simpson et al. | |
| 2004/0071736 A1 | 4/2004 | Quinn et al. | |
| 2004/0208889 A1 | 10/2004 | Sutton et al. | |
| 2004/0219637 A1 | 11/2004 | Williams | |
| 2005/0244435 A1 | 11/2005 | Shone et al. | |
| 2005/0255093 A1 | 11/2005 | Shone et al. | |
| 2006/0051356 A1 | 3/2006 | Foster et al. | |
| 2006/0099672 A1 | 5/2006 | Dolly et al. | |
| 2006/0110410 A1 | 5/2006 | Shone et al. | |
| 2006/0204524 A1 | 9/2006 | Ichtchenko et al. | |
| 2006/0216283 A1 | 9/2006 | Foster et al. | |
| 2007/0259401 A1 | 11/2007 | Dolly et al. | |
| 2008/0032930 A1* | 2/2008 | Steward et al. | 514/12 |
| 2008/0032931 A1 | 2/2008 | Steward et al. | |
| 2008/0081355 A1 | 4/2008 | Dolly et al. | |
| 2008/0161226 A1 | 7/2008 | Steward et al. | |
| 2008/0182294 A1 | 7/2008 | Dolly et al. | |
| 2008/0221012 A1 | 9/2008 | Steward et al. | |
| 2011/0028691 A1* | 2/2011 | Shone et al. | 530/350 |
| 2011/0091437 A1* | 4/2011 | Foster et al. | 424/94.3 |

FOREIGN PATENT DOCUMENTS

| | | |
|---|---|---|
| WO | 93/04191 | 4/1993 |
| WO | 93/15766 | 8/1993 |
| WO | 94/21300 | 9/1994 |
| WO | 94/21684 | 9/1994 |
| WO | 96/12802 | 5/1996 |
| WO | 96/33273 | 10/1996 |
| WO | 98/07864 | 2/1998 |
| WO | 98/08540 | 3/1998 |
| WO | 01/00839 A1 | 1/2001 |
| WO | 01/08390 | 2/2001 |
| WO | 01/14570 A1 | 3/2001 |
| WO | 02/44199 A2 | 6/2002 |
| WO | 2004/024909 A2 | 3/2004 |
| WO | WO 2010/020811 * | 2/2010 |
| WO | WO 2010/094905 * | 8/2010 |
| WO | WO 2011/020052 A1 * | 2/2011 |
| WO | WO 2011/091419 A2 * | 7/2011 |

OTHER PUBLICATIONS

Pellegrini et al, FEBS Letters, 1994, 353:319-323.*
Betley, et al., BBRC, 162/3,pp. 1388-1395 (1989).
Binz, et al., JBC, 269/3, pp. 1617-1620 (1994).
Binz, et al., "The Complete Sequence of Botulinum Neurotoxin type A and Comparison with Other Clostridial Neutoroxins," J. Biol. Chem. 265, pp. 9153-9158, American Society for Biochemistry and Molecular Biology, Inc. (1990).
Bizzini, "Investigation of the Mode of Action of Tetanus Toxin with the Aid of Hybrid Molecules Consisting in Part of Tetanus Toxin-Derived Fragments," in Bacterial Protein Toxins, Academic Press London, pp. 427-434 (1984).
Bowie, et al., Science, 247, pp. 1306-1310 (1990).
Chaddock, et al., Protein Expression and Purification, 25, pp. 219-228 (2002).
Dasgupta, et al., Biochemistry, 26, pp. 4162, Abstract #33 (1987).
Dasgupta, et al., Biochimie, 72, pp. 661-664 (1990).
East, et al., International J. Systematic Bacteriology, 46/4, pp. 1105-1112 (1996).
Fujita, et al., FEBS Letters, 376, pp. 41-44 (1995).
Gimenez, et al., J. Protein Chemistry, 12/3, pp. 351-363 (1993).
Hausinger, et al., "Inhibition by Clostridial Neurotoxins of Calcium-Independent [3H]Noradrenaline Outflow from Freeze-Thawed Synaptosomes: Comparison with Synaptobrevin Hydrolysis," Toxicon 33, pp. 1519-1530, Elsevier Science Ltd. (1995).
Hougten, et al., Vaccine 86, pp. 21-25, editors: Brown et al (1986).
Johnson, et al., Toxicon, 39, pp. 1703-1722 (2001).
Kurazono, et al., "Minimal Essential Domains Specifying Toxicity of the Light Chains of Tetanus Toxin and Botulinum Neurotoxin Type A," J. Biol. Chem. 267, pp. 14721-14729, American Society for Biochemistry and Molecular Biology, Inc. (1992).
Lacy, et al., Nature, 5/10, pp. 898-902 (1998).
Lalli, et al., Trends in Microbiology, 11/9, pp. 431-437 (2003).
Li, et al., "A Single Mutation in the Recombinant Light Chain of Tetanus Toxin Abolishes Its Proteolytic Activity and Removes the Toxicity Seen After Reconstitution with Native Heavy Chain," Biochem. 33, pp. 7014-7020, American Chemical Society (1994).
Montecucco, et al., Molecular Medicine Today, pp. 418-424 (1996).
Niemann, "Molecular Biology of Clostridial Neurotoxins," In Sourcebook of Bacterial Protein Toxins, Ch. 15, Alouf, J. E. and J. H. Freer, eds., Academic Press Limited, London, pp. 303-348 (1991).
Poulain, et al., "Inhibition of Transmitter Release by Botulinum Neurotoxin A: Contribution of Various Fragments to the Intoxication Process," Eur. J. Biochem. 185, pp. 197-203, Springer International (1989).
Riogoni, et al., BBRC, 288, pp. 1231-1237 2001.
Rosetto, et al., Toxicon, 39, pp. 27-41 (2001).
Sathyamoorthy, et al., Archives of Biochemistry and Biophysics, 266/1, pp. 142-151 (1988).
Rudinger, "Characteristics of the Amino Acids as Components of a Peptide Hormone Sequence," In Peptide Hormones, Parsons, J.A., ed., University Park Press, Baltimore, pp. 1-7 (1976).
Schiavo, et al., FEBS, 335/1, pp. 99-103 (1993).
Schmidt, et al., BBRC, 119/3, pp. 900-904 (1984).
Shone, et al., Eur. J. Biochem, 151, pp. 75-82 (1985).
Thompson, et al., Eur. J. Biochem., 189, pp. 73-81 (1990).
Tonello, et al., Protein Expression and Purification, 15, pp. 221-227 (1999).
Turton, et al., Trends in Biochemical Sciences, 27111, pp. 552-558 (2002).
Zhou, et al., "Expression and Purification of the Light Chain of Botulinum Neurotoxin A: A Single Mutation Abolishes Its Cleavage of SNAP-25 and Neurotoxicity After Reconstitution With the Heavy Chain," Biochem. 34, pp. 15175-15181, American Chemical Society (1995).
Helting, et al., "Analysis of the Immune Response to Papain Digestion Products of Tetanus toxin," Acta Path. Microbiol. Immunol. Scand, Sect. C, 92, pp. 59-63 (1984).
Brunger, et al., PLoS Pathogens, Sep. 2007, 3/9: 1191-1194.
Duggan, et al., "Inhibition of release of neurotransmitters from rat dorsal root ganglia by a novel conjugate of a *Clostridium botulinum* toxin A endopeptidase fragment and *Erythrina cristagalli* lectin," J. Biol. Chem., 277: 34846-34852, American Society for Biochemistry and Molecular Biology, Sep. 2002.

* cited by examiner

```
1321/441                                              Eco47 III  1351/451
TCA TTA GAT AAA GGA TAC AAT AAG AAG·CGC GCT GAT GGG GCA TTA AAT GAT TTA TGT ATC AAA
 S   L   D   K   G   Y   N   K   K   R   A   D   G   A   L   N   D   L   C   I   K
                                                                 └──────────────────→
                                                                       H-chain
```

FIG. 5                     (SEQ ID NO: 9)

```
1321/441                                                            1351/451
TCA TTA GAT AAA GGA TAC AAT AAG ATC GAA GGT CGT TGC GAT GGG GCA TTA AAT GAT TTA
 S   L   D   K   G   Y   N   K   I   E   G   R   C   D   G   A   L   N   D   L
                                 └──────────────┘ └──────────────────────────────→
                                    Factor Xa              H-chain
                                  protease motif
```

FIG. 6                     (SEQ ID NO: 11)

```
2587/863
TAC GTA GAT AAT CAA AGA TTA TCT ACA    TTT ACT GAA TAT ATT AAG TCT AGG CCT GGA
 Y   V   D   N   Q   R   L   S   T      F   T   E   Y   I   K   S   R   P   G
2647/883                               2677/893
CCG GAG ACG CTC TGC GGG GCT GAG CTG GTG GAT GCT CTT CAG TTC GTG TGT GGA GAC AGG
 P   E   T   L   C   G   A   E   L   V   D   A   L   Q   F   V   C   G   D   R
2707/903
GGC TTT TAT TTC AAC AAG CCC ACA GGG TAT GGC TCC AGC ACT CGG AGG GCG CCT CAG ACA
 G   F   Y   F   N   K   P   T   G   Y   G   S   S   T   R   R   A   P   Q   T
2767/923                               2797/933
GGT ATC GTG GAT GAG TGC TGC TTC CGG AGC TGT GAT CTA AGG AGG CTG GAG ATG TAT TGC
 G   I   V   D   E   C   C   F   R   S   C   D   L   R   R   L   E   M   Y   C
2827/943
GCA CCC CTC AAG CCT GCC AAG TCA GCT GAA    2857/953
 A   P   L   K   P   A   K   S   A   E     GCT TAG
                                            A  stop (SEQ ID NO: 13)
```

FIG. 7

```
                                                                    CxxA14
2587/863                               2617/873
TAC GTA GAT AAT CAA AGA TTA TCT ACA    TTT ACT GAA TAT ATT AAG TCT AGG CCT CAA
 Y   V   D   N   Q   R   L   S   T      F   T   E   Y   I   K   S   R   P   Q
2647/883                               2677/893
TCT AAA GTT AAA AGA CAA ATA TTT TCA GGC TAT CAA TCT GAT ATT GAT ACA CAT AAT AGA
 S   K   V   K   R   Q   I   F   S   G   Y   Q   S   D   I   D   T   H   N   R
2707/903
ATT AAG GAT GAA TTA TGA
 I   K   D   E   L  stop (SEQ ID NO: 15)
```

FIG. 8

```
2587/863
TAC GTA GAT AAT CAA AGA TTA TCT ACA GAA TTT ACT                    2617/873
 Y   V   D   N   Q   R   L   S   T   E   F   T
2647/883
TCC CCG GGT GCA GCT CAT TAT GCG CAA CAC GAT GAA TAT ATT AAG TCA GGC CTG AAT    2677/893
 S   P   G   A   A   H   Y   A   Q   H   D   E   Y   I   K   S   G   L   N
2707/903
GAA CAA AAC CAA AAC GCG TTC TAT GAG ATC TTA CAT TTA AAC GAC AAA TTC AAC AAA    2737/913
 E   Q   N   Q   N   A   F   Y   E   I   L   H   L   N   D   K   F   N   K
2767/923
AAC GCC TTC ATC CAA AGT TTA AAA GAT GCT CAG GCG CCT AGC CAA AGC GTA GAA CAA CGA  2797/933
 N   A   F   I   Q   S   L   K   D   A   Q   A   P   S   Q   S   V   E   Q   R
2827/943
GCT AAA CTA TTC TAT GAG ATC TTA AAA GAT GAC CCA GCG CCG AAA GTA GAC AAC TTT GCA GAA  2857/953
 A   K   L   F   Y   E   I   L   K   D   D   P   A   P   K   V   D   N   F   A   E
2887/963
CAA AAC GCG CAA AGT TTA AAA GAT GCT CAG GCG CCG AAA GTA GAT AAC TTA CCT AAC CAA CGA AAC  2917/973
 Q   N   A   Q   S   L   K   D   A   Q   A   P   K   V   D   N   L   P   N   Q   R   N
2947/983
TTC ATC CAA AGT TTA AAA GAT GCT CAG GCG CCA AGC CAA AGC GCT AAC CTT TTA GCA GAA CAA    2977/993
 F   I   Q   S   L   K   D   A   Q   A   P   S   Q   S   A   N   L   L   A   E   Q
3007/1003
AAG CTA AAT GAT GCT CAG CCG CCG AAA GTA GAC TAG
 K   L   N   D   A   Q   P   P   K   V   D   *
```

(SEQ ID NO: 17)

FIG. 9

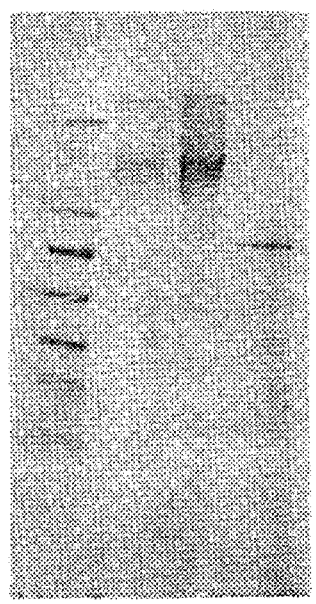 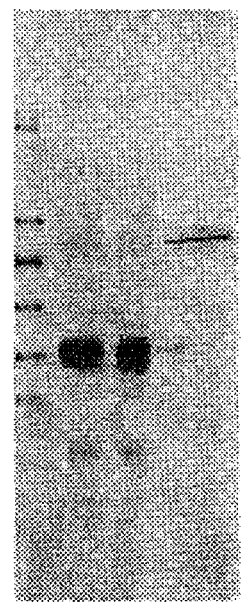
FIG. 13

RECOMBINANT TOXIN FRAGMENTS

This application is a continuation of U.S. patent application Ser. No. 11/717,713, filed on Mar. 14, 2007, now U.S. Pat. No. 7,897,158, which is a continuation of U.S. application Ser. No. 10/241,596, filed Sep. 12, 2002, now U.S. Pat. No. 7,192,596, which is a continuation-in-part of U.S. patent application Ser. No. 09/255,829, filed Feb. 23, 1999, now U.S. Pat. No. 6,461,617, which is a continuation of International Application No. PCT/GB97/02273, filed Aug. 22, 1997, which is a continuation-in-part of U.S. application Ser. No. 08/782,893, filed Dec. 27, 1996, now abandoned. Each of the above applications is incorporated by reference herein in its entirety.

Pursuant to the provisions of 37 C.F.R. §1.52(e)(5), the sequence listing text file named 67050_Seq_Listing.txt, created on Jul. 3, 2008 and having a size of 1224760 bytes, and which is being submitted herewith, is incorporated by reference herein in its entirety.

This invention relates to recombinant toxin fragments, to DNA encoding these fragments and to their uses such as in a vaccine and for in vitro and in vivo purposes.

The clostridial neurotoxins are potent inhibitors of calcium-dependent neurotransmitter secretion in neuronal cells. They are currently considered to mediate this activity through a specific endoproteolytic cleavage of at least one of three vesicle or pre-synaptic membrane associated proteins VAMP, syntaxin or SNAP-25 which are central to the vesicle docking and membrane fusion events of neurotransmitter secretion. The neuronal cell targeting of tetanus and botulinum neurotoxins is considered to be a receptor mediated event following which the toxins become internalised and subsequently traffic to the appropriate intracellular compartment where they effect their endopeptidase activity.

The clostridial neurotoxins share a common architecture of a catalytic L-chain (LC, ca 50 kDa) disulphide linked to a receptor binding and translocating H-chain (HC, ca 100 kDa). The HC polypeptide is considered to comprise all or part of two distinct functional domains. The carboxy-terminal half of the HC (ca 50 kDa), termed the $H_C$ domain, is involved in the high affinity, neurospecific binding of the neurotoxin to cell surface receptors on the target neuron, whilst the amino-terminal half, termed the $H_N$ domain (ca 50 kDa), is considered to mediate the translocation of at least some portion of the neurotoxin across cellular membranes such that the functional activity of the LC is expressed within the target cell. The $H_N$ domain also has the property, under conditions of low pH, of forming ion-permeable channels in lipid membranes, this may in some manner relate to its translocation function.

For botulinum neurotoxin type A (BoNT/A) these domains are considered to reside within amino acid residues 872-1296 for the $H_C$, amino acid residues 449-871 for the $H_N$ and residues 1-448 for the LC. Digestion with trypsin effectively degrades the $H_C$ domain of the BoNT/A to generate a non-toxic fragment designated $LH_N$, which is no longer able to bind to and enter neurons (FIG. 1). The $LH_N$ fragment so produced also has the property of enhanced solubility compared to both the parent holotoxin and the isolated LC.

It is therefore possible to provide functional definitions of the domains within the neurotoxin molecule, as follows:

(A) clostridial neurotoxin light chain:
a metalloprotease exhibiting high substrate specificity for vesicle and/or plasma-membrane associated proteins involved in the exocytotic process. In particular, it cleaves one or more of SNAP-25, VAMP (synaptobrevin/cellubrevin) and syntaxin.

(B) clostridial neurotoxin heavy chain $H_N$ domain:
a portion of the heavy chain which enables translocation of that portion of the neurotoxin molecule such that a functional expression of light chain activity occurs within a target cell.
the domain responsible for translocation of the endopeptidase activity, following binding of neurotoxin to its specific cell surface receptor via the binding domain, into the target cell.
the domain responsible for formation of ion-permeable pores in lipid membranes under conditions of low pH.
the domain responsible for increasing the solubility of the entire polypeptide compared to the solubility of light chain alone.

(C) clostridial neurotoxin heavy chain $H_C$ domain.
a portion of the heavy chain which is responsible for binding of the native holotoxin to cell surface receptor(s) involved in the intoxicating action of clostridial toxin prior to internalisation of the toxin into the cell.

The identity of the cellular recognition markers for these toxins is currently not understood and no specific receptor species have yet been identified although it has been reported that synaptotagmin may be the receptor for botulinum neurotoxin type B. It is probable that each of the neurotoxins has a different receptor.

It is desirable to have positive controls for toxin assays, to develop clostridial toxin vaccines and to develop therapeutic agents incorporating desirable properties of clostridial toxin.

However, due to its extreme toxicity, the handling of native toxin is hazardous.

The present invention seeks to overcome or at least ameliorate problems associated with production and handling of clostridial toxin.

Accordingly, the invention provides a polypeptide comprising first and second domains, wherein said first domain is adapted to cleave one or more vesicle or plasma-membrane associated proteins essential to neuronal exocytosis and wherein said second domain is adapted (i) to translocate the polypeptide into the cell or (ii) to increase the solubility of the polypeptide compared to the solubility of the first domain on its own or (iii) both to translocate the polypeptide into the cell and to increase the solubility of the polypeptide compared to the solubility of the first domain on its own, said polypeptide being free of clostridial neurotoxin and free of any clostridial neurotoxin precursor that can be converted into toxin by proteolytic action. Accordingly, the invention may thus provide a single polypeptide chain containing a domain equivalent to a clostridial toxin light chain and a domain providing the functional aspects of the $H_N$ of a clostridial toxin heavy chain, whilst lacking the functional aspects of a clostridial toxin $H_C$ domain.

In a preferred embodiment, the present invention provides a single chain polypeptide comprising first and second domains, wherein:—
said first domain is a clostridial neurotoxin light chain or a fragment or a variant thereof,
wherein said first domain is capable of cleaving one or more vesicle or plasma membrane associated proteins essential to exocytosis; and
said second domain is a clostridial neurotoxin heavy chain $H_N$ portion or a fragment or a variant thereof, wherein said second domain is capable of (i) translocating the polypeptide into a cell or (ii) increasing the solubility of the polypeptide compared to the solubility of the first domain on its own or (iii) both translocating the polypeptide into a cell and increasing the solubility of the polypeptide compared to the solubility of the first domain on its own; and wherein the second domain lacks a functional C-terminal part of a clostridial neurotoxin heavy chain designated $H_C$ thereby rendering the polypeptide incapable of binding to cell surface receptors that are the natural cell surface receptors to which native clostridial neurotoxin binds.

In the above preferred embodiment, the first domain is qualified by a requirement for the presence of a particular cleavage function. Said cleavage function may be present when the light chain (L-chain) component is part of the single chain polypeptide molecule per se. Alternatively, the cleavage function may be substantially latent in the single chain polypeptide molecule, and may be activated by proteolytic cleavage of the single polypeptide between the first and second domains to form, for example, a dichain polypeptide molecule comprising the first and second domains disulphide bonded together.

The first domain is based on a clostridial neurotoxin light chain (L-chain), and embraces both fragments and variants of said L-chain so long as these components possess the requisite cleavage function. An example of a variant is an L-chain (or fragment thereof) in which one or more amino acid residues has been altered vis-a-vis a native clostridial L-chain sequence. In one embodiment, the modification may involve one or more conservative amino acid substitutions. Other modifications may include the removal or addition of one or more amino acid residues vis-a-vis a native clostridial L-chain sequence. However, any such fragment or variant must retain the aforementioned cleavage function.

The structure of clostridial neurotoxins was well known prior to the present invention—see, for example, Kurazono et al (1992) J. Biol. Chem., 267, 21, pp. 14721-14729. In particular, the Kurazono paper describes the minimum Domains required for cleavage activity (eg. proteolytic enzyme activity) of a clostridial neurotoxin L-chain. Similar discussion is provided by Poulain et al (1989) Eur. J. Biochem., 185, pp. 197-203, by Zhou et al (1995), 34, pp. 15175-15181, and by Blaustein et al (1987), 226, No. 1, pp. 115-120.

By way of exemplification, Table II on page 14726 of Kurazono et al. (1992) illustrates a number of L-chain deletion mutants (both amino-terminal and carboxy-terminal L-chain deletion mutants are illustrated). Such mutants, together with other L-chain mutants containing, for example, similar amino acid deletions or conservative amino acid substitutions are embraced by the first domain definition of the present invention provided that the L-chain component in question has the requisite cleavage activity.

Prior to the present application a number of conventional, simple assays were available to allow a skilled person to routinely confirm whether a given L-chain (or equivalent L-chain component) had the requisite cleavage activity. These assays are based on the inherent ability of a functional L-chain to effect peptide cleavage of specific vesicle or plasma membrane associated proteins (eg. synaptobrevin, syntaxin, or SNAP-25) involved in neuronal exocytosis, and simply test for the presence of the cleaved product/s of said proteolytic reaction.

For example, in a rough-and-ready assay, SNAP-25 (or synaptobrevin, or syntaxin) may be challenged with a test L-chain (or equivalent L-chain component), and then analysed by SDS-PAGE peptide separation techniques. Subsequent detection of peptides (eg. by silver staining) having molecular weights corresponding to the cleaved products of SNAP-25 (or other component of the neurosecretory machinery) would indicate the presence of an L-chain (or equivalent L-chain component) possessing the requisite cleavage activity.

In an alternative assay, SNAP-25 (or a different neuronal exocytosis molecule) may be challenged with a test L-chain (or equivalent L-chain component), and the cleavage products subjected to antibody detection as described in PCT/GB95/01279 (ie. WO95/33850) in the name of the present Applicant, Microbiological Research Authority. In more detail, a specific antibody is employed for detecting the cleavage of SNAP-25, which antibody recognises cleaved SNAP-25 but not uncleaved SNAP-25. Identification of the cleaved product by the antibody confirms the presence of an L-chain (or equivalent L-chain component) possessing the requisite cleavage activity. By way of exemplification, such a method is described in Examples 2 and 3 of PCT/GB96/00916 (ie. WO96/33273), also in the name of Microbiological Research Authority.

In a preferred embodiment of the present invention, the second domain is qualified by the ability to provide one or both of two functions, namely (i) translocation and/or (ii) increased solubility of the first domain.

The second domain is based on a $H_N$ portion of a clostridial neurotoxin, which portion has been extensively described and characterised in the literature. Particular mention is made to Kurazono et al (1992) in which the structure of clostridial neurotoxin heavy chains is discussed together with the functions associated with the $H_N$ and $H_C$ portions thereof [see, for example, the bottom illustration in FIG. 1 on page 14722 of Kurazono et al (1992)]. In more detail, the $H_N$ domain is a domain of a clostridial neurotoxin that functions to translocate a clostridial L-chain across the endosomal membrane of a vesicle, and is synonymous with the $H_2$ domain of a clostridial neurotoxin [see the bottom left-hand column and footer on page 197 of Poulain, B. et al (1989); see FIG. 1 in Blaustein, R. et al (1987); and see also the sentence bridging pages 178 and 179 of Shone, C. et al (1987), Eur. J. Biochem., 167, pp. 175-180].

The second domain definition of the present invention includes fragments and variants of the $H_N$ portion of a clostridial neurotoxin so long as these components provide the requisite (I) translocation and/or (ii) improved solubility function. An example of a variant is an $H_N$ portion (or fragment thereof) in which one or more amino acid residues has been altered vis-a-vis a native clostridial $H_N$ domain sequence. In one embodiment, the modification may involve one or more conservative amino acid substitutions. Other modifications may include the removal or addition of one or more amino acid residues vis-a-vis a native clostridial $H_N$ sequence. However, any such fragment or variant must provide the aforementioned (i) translocation and/or (ii) improved solubility function.

The (i) translocation and (ii) improved solubility functions are now described in more detail.

Prior to the present application a number of conventional, simple assays were available to allow a skilled person to routinely confirm whether a particular clostridial neurotoxin $H_N$ portion (or equivalent $H_N$ component) had the requisite translocation function. In this respect, particular mention is made to the assays described in Shone et al. (1987) and Blaustein et al. (1987), which are now discussed.

These papers describe studies of the translocation function of clostridial neurotoxins, and demonstrate that the ability of said neurotoxins to form channels is associated with the presence of a translocation function.

Shone et al. (1987) describes an assay employing artificial liposomes loaded with potassium phosphate buffer (pH 7.2) and radiolabelled NAD. Thus, to confirm whether a test $H_N$ portion (or equivalent H-chain component) of a clostridial neurotoxin has the requisite translocation function, the artificial liposomes are challenged with the test $H_N$ portion. The release of K⁺ and NAD from the liposomes is indicative of a channel-forming activity, and thus the presence of a translocation function.

An alternative assay is described by Blaustein et al. (1987), wherein planar phospholipid bilayer membranes are used to test for channel-forming activity. Salt solutions on either side of the membrane are buffered at different pH—on the cis side, pH 4.7 or 5.5 and on the trans side, pH 7.4. Thus, to confirm whether a $H_N$ portion (or equivalent H-chain component) of a clostridial neurotoxin has the requisite translocation function, the test $H_N$ portion is added to the cis side of the membrane and electrical measurements made under voltage clamp conditions, in order to monitor the flow of current across the membrane (see paragraph 2.2 on pages 116-118). The presence of a desired translocation activity is confirmed by a steady rate of channel turn-on (see paragraph 3 on page 118).

Turning now to the second heavy chain function, namely (ii) increased solubility of the first domain. A conventional problem associated with the preparation of a clostridial neurotoxin L-chain molecules is that said L-chain molecules generally possess poor solubility characteristics. Thus, in one embodiment of the present invention, the fusion of a second domain (based on a $H_N$ portion of a clostridial neurotoxin) to the L-chain increases the solubility of the L-chain. Similarly, the addition of a second domain to a L-chain equivalent molecule (eg. a fragment, or variant of a L-chain) increases the solubility of the L-chain equivalent molecule.

Prior to the present application a number of conventional, simple assays were available to allow a skilled person to routinely confirm whether a particular clostridial neurotoxin $H_N$ portion (or equivalent $H_N$ component) had the requisite ability to increase the solubility of a L-chain (or equivalent L-chain component). The most common method to assess solubility is through use of centrifugation, followed by a range of protein determination methods. For example, lysed *E. coli* cells containing expressed clostridial endopeptidase are centrifuged at 25,000×g for 15 minutes to pellet cell debris and aggregated protein material. Following removal of the supernatant (containing soluble protein) the cell debris can be reconstituted in SDS-containing sample buffer (to solubilise the poorly soluble protein), prior to analysis of the two fractions by SDS-PAGE. Coomassie blue staining of electrophoresed protein, followed by densitometric analysis of the relevant protein band, facilitates a semi-quantitative analysis of solubility of expressed protein.

A further requirement of the single polypeptide molecule according to a preferred embodiment of the present invention is that the second domain lacks a functional C-terminal part of a clostridial neurotoxin heavy chain designated $H_C$, thereby rendering the polypeptide incapable of binding to cell surface receptors that are the natural cell surface receptors to which a native clostridial neurotoxin binds. This requirement is now discussed in more detail, and reference to incapable of binding throughout the present specification is to be interpreted as substantially incapable of binding, or reduced in binding ability when compared with native clostridial neurotoxin.

It has been well documented, for example in the above-described literature and elsewhere, that native clostridial neurotoxin binds to specific target cells through a binding interaction that involves the $H_C$ domain of the toxin heavy chain and a specific receptor on the target cell.

However, in contrast to native neurotoxin, the single polypeptide molecules according to a preferred embodiment of the present invention lack a functional $H_C$ domain of native clostridial neurotoxin. Thus, the preferred single polypeptide molecules of the present invention are not capable of binding to the specific receptors targeted by native clostridial neurotoxin.

Prior to the present application a number of conventional, simple assays were available to allow a skilled person to routinely confirm whether a particular clostridial neurotoxin $H_N$ portion (or equivalent $H_N$ component) lacked the binding ability of native clostridial neurotoxin. In this respect, particular mention is made to the assays described by Shone et al. (1985) Eur. J. Biochem., 151 (1), pp. 75-82, and by Black & Dolly (1986) J. Cell. Biol., 103, pp. 521-534. The basic Shone et al (1985) method has been recently repeated in Sutton et al (2001), 493, pp. 45-49 to assess the binding ability of tetanus toxins.

These papers describe simple methods for assessing binding of the H-chain of a clostridial neurotoxin to its target cells, motor neurons. Hence, these methods provide a means for routinely determining whether a modification to the H-chain results in a loss of or reduced native binding affinity of the H-chain for motor neurons. The methods are now discussed in more detail.

The Shone et al (1985) method is based on a competitive binding assay in which test neurotoxin H-chain fragments are compared with radiolabelled native neurotoxin in their ability to bind to purified rat cerebrocortical synaptosomes (ie. native toxin target cells). A reduction of $H_C$ function (ie. binding ability) is demonstrated by a reduced ability of the test H-chain fragments to compete with the labelled intact toxin for binding to the synaptosomes (see page 76, column 1 to line 51-column 2, line 5).

Sutton et al. (2001) carried out similar competitive binding experiments using radiolabelled intact tetanus neurotoxin (TeNT) and unlabelled site-directed (TeNT) mutants. As above, a positive result in the assay is demonstrated by an inability of the mutant fragments to compete with the labelled TeNT for binding to synaptosomes.

An alternative approach is described by Black & Dolly (1986), which method employed electron microscopic autoradiography to visually assess binding of radiolabelled clostridial neurotoxins at the vertebrate neuromuscular junction, both in vivo and in vitro. Thus, this assay represents a simple visual method for confirming whether a test $H_N$ domain (or equivalent $H_N$ component) lacks a functional $H_C$ domain.

There are numerous ways by which a second domain that lacks a functional $H_C$ domain may be prepared. In this respect, inactivation of the $H_C$ domain may be achieved at the amino acid level (eg. by use of a derivatising chemical, or a proteolytic enzyme), or at the nucleic acid level (eg. by use of site-directed mutagenesis, nucleotide/s insertion or deletion or modification, or by use of truncated nucleic acid).

For example, it would be routine for a skilled person to select a conventional derivatising chemical or proteolytic agent suitable for removal or modification of the $H_C$ domain. Standard derivatising chemicals and proteolytic agents are readily available in the art, and it would be routine for a skilled person to confirm that said chemicals/agents provide an $H_N$ domain with reduced or removed native binding affinity by following any one of a number of simple tests such as those described above.

Conventional derivatising chemicals may include any one of the following, which form a non-exhaustive list of examples:—
 (1) tyrosine derivatising chemicals such as anhydrides, more specifically maleic anhydride;

(2) diazonium based derivatising chemicals such as bis-Diazotized o-Tolidine, and diazotized p-aminobenzoyl biocytin;
(3) EDC (1-ethyl 1-3-(3-dimethylaminopropyl) carbodiimide hydrochloride);
(4) isocyanate based derivatising chemicals such as dual treatment with tetranitromethane followed by sodium dithionite; and
(5) iodinating derivatising chemicals such as chloramine-T (N-chlorotoluene sulfonamide) or IODO-GEN (1,3,4,6-tetrachloro-3a,ba-diphenylglycouril).

Conventional proteolytic agents may include any one of the following, which form a non-exhaustive list of examples:—
(1) trypsin [as demonstrated in Shone et al (1985)];
(2) proline endopeptidase
(3) lys C proteinase;
(4) chymotrypsin;
(5) thermolysin; and
(6) arg C proteinase.

Alternatively, conventional nucleic acid mutagenesis methods may be employed to generate modified nucleic acid sequences that encode second domains lacking a functional $H_C$ domain. For example, mutagenesis methods such as those described in Kurazono et al (1992) may be employed. A range of systems for mutagenesis of DNA are available, based on the DNA manipulation techniques described by:—Kunkel T. (1985) Proc. Natl. Acad. Sci. USA, 82, pp. 488-492; Taylor, J. W. et al. (1985) Nucleic Acids Res. 13, pp. 8749-8764 (1995); and Deng G. & Nickeloff J. A. (1992) Anal. Biochem., 200, pp. 81-88.

According to all general aspects of the present invention, a polypeptide of the invention can be soluble but lack the translocation function of a native toxin—this is of use in providing an immunogen for vaccinating or assisting to vaccinate an individual against challenge by toxin. In a specific embodiment of the invention described in an example below a polypeptide designated $LH_{423}/A$ elicited neutralising antibodies against type A neurotoxin. A polypeptide of the invention can likewise thus be relatively insoluble but retain the translocation function of a native toxin—this is of use if solubility is imparted to a composition made up of that polypeptide and one or more other components by one or more of said other components.

The first domain of the polypeptide of the invention cleaves one or more vesicle or plasma-membrane associated proteins essential to the specific cellular process of exocytosis, and cleavage of these proteins results in inhibition of exocytosis, typically in a non-cytotoxic manner. The cell or cells affected are not restricted to a particular type or subgroup but can include both neuronal and non-neuronal cells. The activity of clostridial neurotoxins in inhibiting exocytosis has, indeed, been observed almost universally in eukaryotic cells expressing a relevant cell surface receptor, including such diverse cells as from Aplysia (sea slug), *Drosophila* (fruit fly) and mammalian nerve cells, and the activity of the first domain is to be understood as including a corresponding range of cells.

The polypeptide of the invention may be obtained by expression of a recombinant nucleic acid, preferably a DNA, and is a single polypeptide, that is to say not cleaved into separate light and heavy chain domains. The polypeptide is thus available in convenient and large quantities using recombinant techniques.

In a polypeptide according to the invention, said first domain preferably comprises a clostridial toxin light chain or a fragment or variant of a clostridial toxin light chain. The fragment is optionally an N-terminal, or C-terminal fragment of the light chain, or is an internal fragment, so long as it substantially retains the ability to cleave the vesicle or plasma-membrane associated protein essential to exocytosis. The minimal domains necessary for the activity of the light chain of clostridial toxins are described in J. Biol. Chem., Vol. 267, No. 21, July 1992, pages 14721-14729. The variant has a different peptide sequence from the light chain or from the fragment, though it too is capable of cleaving the vesicle or plasma-membrane associated protein. It is conveniently obtained by insertion, deletion and/or substitution of a light chain or fragment thereof. In embodiments of the invention described below a variant sequence comprises (i) an N-terminal extension to a clostridial toxin light chain or fragment (ii) a clostridial toxin light chain or fragment modified by alteration of at least one amino acid (iii) a C-terminal extension to a clostridial toxin light chain or fragment, or (iv) combinations of 2 or more of (i)-(iii).

The first domain preferably exhibits endopeptidase activity specific for a substrate selected from one or more of SNAP-25, synaptobrevin/VAMP and syntaxin. The clostridial toxin is preferably botulinum toxin or tetanus toxin.

In one embodiment of the invention described in an example below, the toxin light chain and the portion of the toxin heavy chain are of botulinum toxin type A. In a further embodiment of the invention described in an example below, the toxin light chain and the portion of the toxin heavy chain are of botulinum toxin type B. The polypeptide optionally comprises a light chain or fragment or variant of one toxin type and a heavy chain or fragment or variant of another toxin type.

In a polypeptide according to the invention said second domain preferably comprises a clostridial toxin heavy chain $H_N$ portion or a fragment or variant of a clostridial toxin heavy chain $H_N$ portion. The fragment is optionally an N-terminal or C-terminal or internal fragment, so long as it retains the function of the $H_N$ domain. Teachings of regions within the $H_N$ responsible for its function are provided for example in Biochemistry 1995, 34, pages 15175-15181 and Eur. J. Biochem, 1989, 185, pages 197-203. The variant has a different sequence from the $H_N$ domain or fragment, though it too retains the function of the $H_N$ domain. It is conveniently obtained by insertion, deletion and/or substitution of a $H_N$ domain or fragment thereof. In embodiments of the invention, described below, it comprises (i) an N-terminal extension to a $H_N$ domain or fragment, (ii) a C-terminal extension to a $H_N$ domain or fragment, (iii) a modification to a $H_N$ domain or fragment by alteration of at least one amino acid, or (iv) combinations of 2 or more of (i)-(iii). The clostridial toxin is preferably botulinum toxin or tetanus toxin.

The invention also provides a polypeptide comprising a clostridial neurotoxin light chain and a N-terminal fragment of a clostridial neurotoxin heavy chain, the fragment preferably comprising at least 423 of the N-terminal amino acids of the heavy chain of botulinum toxin type A, 417 of the N-terminal amino acids of the heavy chain of botulinum toxin type B or the equivalent number of N-terminal amino acids of the heavy chain of other types of clostridial toxin such that the fragment possesses an equivalent alignment of homologous amino acid residues.

These polypeptides of the invention are thus not composed of two or more polypeptides, linked for example by di-sulphide bridges into composite molecules. Instead, these polypeptides are single chains and are not active or their activity is significantly reduced in an in vitro assay of neurotoxin endopeptidase activity.

Further, the polypeptides may be susceptible to be converted into a form exhibiting endopeptidase activity by the action of a proteolytic agent, such as trypsin. In this way it is possible to control the endopeptidase activity of the toxin light chain.

In further embodiments of the invention, the polypeptide contains an amino acid sequence modified so that (a) there is no protease sensitive region between the LC and $H_N$ components of the polypeptide, or (b) the protease sensitive region is specific for a particular protease. This latter embodiment is of use if it is desired to activate the endopeptidase activity of the light chain in a particular environment or cell. Though, in general, the polypeptides of the invention are activated prior to administration.

More generally, a proteolytic cleavage site may be introduced between any two domains of the single chain polypeptide molecule.

For example, a cleavage site may be introduced between the first and second domains such that cleavage thereof converts the single chain polypeptide molecule into a dichain polypeptide structure wherein the first and second domains are linked together by a disulphide bond. Specific Examples of such molecules are provided by SEQ IDs 11-18 of the present application in which an Factor Xa cleavage site has been introduced between the first domain (L-chain) and the second domain ($H_N$).

A range of peptide sequences having inherent cleavage sites are available for insertion into the junction between one or more domains of a polypeptide according to the present invention. For example, insertion of a cleavage site between the first (L-chain) and second ($H_N$) domains may result in a single polypeptide chain molecule that is proteolytically cleavable to form a dichain polypeptide in which the first and second domains are held together by a disulphide bond between the first and second domains. The proteolytic cleavage may be performed in vitro prior to use, or in vivo by cell specific activation through intracellular proteolytic action.

Alternatively (or additionally), a cleavage site may be introduced between the second and third domains, or between the purification tag and the polypeptide of the present invention. The third domain and purification tag aspects of the present invention are discussed in more detail below.

To facilitate convenient insertion of a range of cleavage sites into the junction between the LC and $H_N$ domains, it is preferable to prepare an expression clone that can serve as a template for future clone development. Such a template is represented by SEQ ID 103, in which the DNA encoding $LH_N/B$ has been modified by standard mutagenesis techniques to incorporate unique restriction enzyme sites. To incorporate new cleavage sites at the junction requires simple insertion of novel oligonucleotides encoding the new cleavage site.

Suitable cleavage sites include, but are not limited to, those described in Table 1.

TABLE 1

Cleavage site (eg. between the first and second domains for $LH_N$ activation)

| Protease | Amino acid sequence of recognition site | SEQ ID exemplification |
| --- | --- | --- |
| Factor Xa | I-E/D-G-R⇓ | 71/72, 33/34, 55/56, 57/58, 115/116, 117/118, 119/120, 121/122 |
| Enterokinase | D-D-D-D-K⇓ | 69/70, 31/32, 29/30, 43/44, 45/46, 113/114, 111/112, 59/60, 61/62, 63/64, 65/66, 79/80, 81/82, 83-98, 105/106, 107/108 |

TABLE 1-continued

Cleavage site (eg. between the first and second domains for $LH_N$ activation)

| Protease | Amino acid sequence of recognition site | SEQ ID exemplification |
| --- | --- | --- |
| Precission | L-E-V-L-F-Q⇓G-P | 75/76, 35/36, 51/52, 53/54 |
| Thrombin | L-V-P-R⇓G-S | 77/78, 37/38, 47/48, 49/50, 99/100 |
| Genenase | H-Y⇓ or Y⇓-H | |
| TEV | E-N-L-Y-F-Q⇓G | 101/102 |
| Furin | R-X-X-R⇓,preferred R-X-K/R-R⇓ | |

(wherein X = any amino acid)

In some cases, the use of certain cleavage sites and corresponding proteolytic enzymes (eg. precission, thrombin) will leave a short N-terminal extension on the polypeptide at a position C-terminal to the cleavage site (see the ⇓ cleavage pattern for the exemplified proteases in Table 1).

Peptide sequences may be introduced between any two domains to facilitate specific cleavage of the domains at a later stage. This approach is commonly used in proprietary expression systems for cleavage and release of a purification tag (eg. maltose-binding protein (MBP), glutathione S-transferase (GST), polyhistidine tract (His6)) from a fusion protein that includes the purification tag. In this respect, the purification tag is preferably fused to the N- or C-terminus of the polypeptide in question.

The choice of cleavage site may have a bearing on the precise nature of the N-terminus (or C-terminus) of the released polypeptide. To illustrate this, identical $LH_N/B$ fragments produced in such proprietary systems are described in SEQ ID 88, 94, 96, 98, in which the N-terminal extensions to the $LH_N/B$ sequence are ISEFGS, GS, SPGARGS & AMADIGS respectively. In the case of $LH_N/C$ fragments, SEQ ID 126, 128 & 130 describe the N-terminal sequences VPEFGSSRVDH, ISEFGSSRVDH and VPEFGSSRVDH following release of the $LH_N/C$ fragment from its fusion tag by enterokinase, genenase and Factor Xa respectively. Each of these extension peptide sequences is an example of a variant L-chain sequence of the present invention. Similarly, if the purification tag were to be fused to the C-terminal end of the second domain, the resulting cleaved polypeptide (ie. fusion protein minus purification tag) would include C-terminal extension amino acids. Each of these extension peptides provides an example of a variant $H_N$ portion of the present invention.

In some cases, cleavage at a specific site, for example, between a purification tag and a polypeptide of the present invention may be of lower efficiency than desired. To address this potential problem, the present Applicant has modified proprietary vectors in two particular ways, which modifications may be employed individually or in combination with each other. Whilst said modifications may be applied to cleavage sites between any two domains in a polypeptide or fusion protein according to the present invention, the following discussion simply illustrates a purification tag-first domain cleavage event.

First, the DNA is modified to include an additional peptide spacer sequence, which optionally may represent one or more additional cleavage sites, at the junction of the purification tag and the polypeptide. Examples of the full-length expressed polypeptide from this approach are presented in SEQ ID 86, 90 & 92. Such an approach has resulted in efficient cleavage and release of the polypeptide of interest. Depending on the presence and nature of any intra-polypeptide cleavage sites (eg. between the first and second domains), cleavage of the purification tag from the fusion protein may occur simultaneously to proteolytic cleavage between the first and second domains. Alternatively, release of the purification tag may occur without proteolytic cleavage between the first and second domains. These two cleavage schemes are illustrated in FIG. 14.

Depending on the cleavage enzyme chosen, this strategy may result in a short amino acid extension to the N-terminus (or C-terminus) of the polypeptide. For example, in the case of SEQ ID 92, cleavage of the expressed product with enterokinase results in two polypeptides coupled by a single disulphide bond at the first domain-second domain junction (ie. the L chain-$H_N$ junction), with a short N-terminal peptide extension that resembles an intact Factor Xa site and a short N-terminal extension due to polylinker sequence (IE-GRISEFGS).

Secondly, the DNA encoding a self-splicing intein sequence may be employed, which intein may be induced to self-splice under pH and/or temperature control. The intein sequence (represented in SEQ ID 110 as the polypeptide sequence ISEFRESGAISGDSLISLAST-GKRVSIKDLLDEKDFEIWAINEQTMKLE-SAKVSRVFCTG KKLVYILKTRLGRTIKATANHR-FLTIDGWKRLDELSLKEHIALPRKLESSSLQLSPEIEKL SQSDIYWDSIVSITETGVEEVFDLTVPG-PHNFVANDIIVHN) facilitates self-cleavage of the illustrated polypeptide (ie. purification tag-LH$_N$/B) to yield a single polypeptide molecule with no purification tag. This process does not therefore require treatment of the initial expression product with proteases, and the resultant polypeptide (ie. L-chain—Factor Xa activation site—H$_N$) is simply illustrative of how this approach may be applied.

According to a further embodiment of the invention, which is described in an example below, there is provided a polypeptide lacking a portion designated $H_C$ of a clostridial toxin heavy chain. This portion, seen in the naturally produced toxin, is responsible for binding of toxin to cell surface receptors prior to internalisation of the toxin. This specific embodiment is therefore adapted so that it can not be converted into active toxin, for example by the action of a proteolytic enzyme. The invention thus also provides a polypeptide comprising a clostridial toxin light chain and a fragment of a clostridial toxin heavy chain, said fragment being not capable of binding to those cell surface receptors involved in the intoxicating action of clostridial toxin, and it is preferred that such a polypeptide lacks an intact portion designated $H_C$ of a clostridial toxin heavy chain.

In further embodiments of the invention there are provided compositions containing a polypeptide comprising a clostridial toxin light chain and a portion designated $H_N$ of a clostridial toxin heavy chain, and wherein the composition is free of clostridial toxin and free of any clostridial toxin precursor that may be converted into clostridial toxin by the action of a proteolytic enzyme. Examples of these compositions include those containing toxin light chain and $H_N$ sequences of botulinum toxin types A, B, $C_1$, D, E, F and G.

The polypeptides of the invention are conveniently adapted to bind to, or include, a third domain (eg. a ligand for targeting to desired cells). The polypeptide optionally comprises a sequence that binds to, for example, an immunoglobulin. A suitable sequence is a tandem repeat synthetic IgG binding domain derived from domain B of *Staphylococcal* protein A. Choice of immunoglobulin specificity then determines the target for a polypeptide—immunoglobulin complex. Alternatively, the polypeptide comprises a non-clostridial sequence that binds to a cell surface receptor, suitable sequences including insulin-like growth factor-1 (IGF-1) which binds to its specific receptor on particular cell types and the 14 amino acid residue sequence from the carboxy-terminus of cholera toxin A subunit which is able to bind the cholera toxin B subunit and thence to GM1 gangliosides. A polypeptide according to the invention thus, optionally, further comprises a third domain adapted for binding of the polypeptide to a cell.

According to a second aspect the invention there is provided a fusion protein comprising a fusion of (a) a polypeptide of the invention as described above with (b) a second polypeptide (also known as a purification tag) adapted for binding to a chromatography matrix so as to enable purification of the fusion protein using said chromatography matrix. It is convenient for the second polypeptide to be adapted to bind to an affinity matrix, such as a glutathione Sepharose, enabling rapid separation and purification of the fusion protein from an impure source, such as a cell extract or supernatant.

One possible second purification polypeptide is glutathione-S-transferase (GST), and others will be apparent to a person of skill in the art, being chosen so as to enable purification on a chromatography column according to conventional techniques.

According to another embodiment of the present invention, spacer sequences may be introduced between two or more domains of the single chain polypeptide molecule. For example, a spacer sequence may be introduced between the second and third domains of a polypeptide molecule of the present invention. Alternatively (or in addition), a spacer sequence may be introduced between a purification tag and the polypeptide of the present invention or between the first and second domains. A spacer sequence may include a proteolytic cleavage site.

In more detail, insertion of a specific peptide sequence into the second domain-third domain junction may been performed with the purpose of spacing the third domain (eg. ligand) from the second domain (eg. H$_N$). This approach may facilitate efficient interaction of the third domain with the specific binding target and/or improve the folding characteristics of the polypeptide. Example spacer peptides are provided in Table 2.

TABLE 2 spacer sequences

| Sequence | Illustrated in SEQ ID No |
|---|---|
| (GGGGS)$_3$ | 39/40, 43/44, 49/50, 53/54, 57/58 |
| RNAse A loop | 138/139 |
| Helical | 41/42, 45/46, 47/48, 51/52, 55/56 |
| Att sites (TSLYKKAGFGS or DPAFLYKV) | 133 |

In a preferred embodiment, a spacer sequence may be introduced between the first and second domains. For example, a variety of first domain (eg. L-chain) expression constructs have been prepared that incorporate features that are advantageous to the preparation of novel single polypeptide hybrid first domain-second domain fusions. Such expression cassettes are illustrated by SEQ ID NO 69, 71, 73, 75, 77 & 113.

The above cassettes take advantage of a natural linker sequence that exists in the region between the C-terminus of the L-chain and the N-terminus of the H$_N$ domain of a native clostridial neurotoxin. In more detail, there is a cysteine at each end of the natural linker sequence that serve to couple the L-chain and $H_N$ domain together following proteolytic cleavage of the single chain polypeptide molecule into its dichain counterpart. These cysteine groups are preserved in the above-mentioned cassettes. Thus, by maintaining the cysteine amino acids at either end of the linker sequence, and optionally incorporating a specific proteolytic site to replace the native sequence, a variety of constructs have been prepared that have the property of being specifically cleavable between the first and second domains.

For example, by fusing a sequence of interest, such as $H_N$/B to the sequence described in SEQ ID 69, it is possible to routinely prepare L-chain/A-$H_N$/B novel hybrids that are linked through a specific linker region that facilitates disulphide bond formation. Thus, the expressed fusion proteins are suitable for proteolytic cleavage between the first (L-chain) and second ($H_N$) domains. The same linkers, optionally including said cleavage site, may be used to link together other domains of the polypeptide or fusion protein of the present invention.

In a further embodiment of the present invention, molecular clamps may be used to clamp together two or more domains of the polypeptides or fusion proteins of the present invention. Molecular clamps may be considered a particular sub-set of the aforementioned spacer sequences.

In more detail, molecular clamping (also known as directed coupling) is a method for joining together two or more polypeptide domains through the use of specific complementary peptide sequences that facilitate non-covalent protein-protein interactions.

Examples of such peptide sequences include leucine zippers (jun & fos), polyionic peptides (eg. poly-glutamate and its poly-arginine pair) and the synthetic IgG binding domain of *Staphylococcal* protein A.

Polypeptides comprising first and second domains (eg. $LH_N$) have been prepared with molecular clamping sequences fused to the C-terminus of the second (eg. $H_N$) domain through two methods.

First, DNA encoding the molecular clamp has been ligated directly to the DNA encoding an $LH_N$ polypeptide, after removing the STOP codon present in the $LH_N$ coding sequence. By insertion, to the 3' of the $LH_N$ sequence, of overlapping oligonucleotides encoding the clamp sequence and a 3' STOP codon, an expression cassette has been generated. An example of such a sequence is presented in SEQ ID 63 in which the DNA sequence coding for the molecular clamp known as fos (LTDTLQAETDQLEDEKSALQTE-IANLLKEKEKLEFILAAH) has been introduced to the 3' of a nucleic acid molecule encoding a $LH_N$/A polypeptide, which molecule also has a nucleic acid sequence encoding an enterokinase cleavage site between the coding regions of the first domain (L-chain) and the second domain ($H_N$).

Secondly, site-specific recombination has been utilised to incorporate a clamp sequence to the 3' of a $LH_N$ polypeptide (see, for example, the GATEWAY system described below) spaced from the $H_N$ domain by the short peptide Gly-Gly. Use of this peptide to space clamp sequences from the C-terminus of $H_N$ is illustrated in SEQ 117/118.

In some embodiments, it may be preferable to incorporate cysteine side chains into the clamp peptide to facilitate formation of disulphide bonds across the clamp, and so make a covalent linkage between the, for example, second domain ($H_N$) and a third domain (eg. a ligand). Incorporation of the cysteine codon into the clamp sequence has been performed by standard techniques, to result in sequences of the type represented by SEQ ID 59/60, 61/62, 117/118 and 119/120.

A schematic for the application of molecular clamping to the preparation of suitable $LH_N$ polypeptides is illustrated in FIG. 15.

A further alternative for expression of a full-length polypeptide containing first and second domains that is suitable for site-specific coupling to a third domain (eg. a ligand) is to incorporate an intein self-cleaving sequence into the 3' of the second domain (eg. $H_N$). SEQ ID 67/68 illustrates one such construct, in which $LH_N$/A having an enterokinase cleavage site between the first (eg. L-chain) and second (eg. $H_N$) domains is expressed with a Cys residue at the C-terminus, followed by the intein sequence. Following self-cleavage, a reactive thioester is then formed that can take part in a directed coupling reaction to a third domain, for example, as described by Bruick et al, Chem. Biol. (1996), pp. 49-56. Such a polypeptide facilitates site-specific chemical coupling to third domains (eg. ligands of interest) without the problems associated with random derivatisation and random coupling which may otherwise result in a heterogenous final product.

As will be appreciated by a skilled person from the entire disclosure of the present application, first and second domains may employ L-chain and H-chain components from any clostridial neurotoxin source. Whilst botulinum sources may be preferred, tetanus sources have equal applicability. In this respect, the whole sequence of tetanus neurotoxin (TeNT) as published prior to the present application by Eisel, U. et al (1986) EMBO J. 5 (10), pp. 2495-2502, and Accession No. X04436 is included in the present application as SEQ ID 140/141 for ease of reference.

To help illustrate this point, several TeNT based polypeptides have been prepared according to the present invention, and reference is made to SEQ ID 143 which is an $LH_N$ polypeptide having a C-terminal sequence of $EEDIDV_{879}$. Reference is also made to SEQ ID 147 which is an $LH_N$ polypeptide having a C-terminal sequence of EEDID-$VILKKSTIL_{887}$. Both of these $LH_N$ sequences are representative of 'native' TeNT $LH_N$ sequences, which have no introduced specific cleavage site between the L-chain and the $H_N$ domain. Thus, SEQ ID 145 illustrates a TeNT polypeptide according to the present invention in which the natural TeNT linker region between the L-chain and the $H_N$ domain has been replaced with a polypeptide containing a specific enterokinase cleavage sequence.

It will be also appreciated that the general approaches described in the present specification for introducing specific cleavage sites and spacer/clamping sequences between any two domains (eg. the L-chain and the $H_N$ domain, or the L-chain and a purification tag) are routinely applicable to the preparation of TeNT-containing polypeptide molecules according to the present invention.

A third aspect of the invention provides a composition comprising a derivative of a clostridial toxin, said derivative retaining at least 10% of the endopeptidase activity of the clostridial toxin, said derivative further being non-toxic in vivo due to its inability to bind to cell surface receptors, and wherein the composition is free of any component, such as toxin or a further toxin derivative, that is toxic in vivo. The activity of the derivative preferably approaches that of natural toxin, and is thus preferably at least 30% and most preferably at least 60% of natural toxin. The overall endopeptidase activity of the composition will, of course, also be determined by the amount of the derivative that is present.

While it is known to treat naturally produced clostridial toxin to remove the $H_C$ domain, this treatment does not totally remove toxicity of the preparation, instead some residual toxin activity remains. Natural toxin treated in this way is therefore still not entirely safe. The composition of the invention, derived by treatment of a pure source of polypeptide advantageously is free of toxicity, and can conveniently be used as a positive control in a toxin assay, as a vaccine against clostridial toxin or for other purposes where it is essential that there is no residual toxicity in the composition.

The invention enables production of the polypeptides and fusion proteins of the invention by recombinant means.

A fourth aspect of the invention provides a nucleic acid encoding a polypeptide or a fusion protein according to any of the aspects of the invention described above.

In one embodiment of this aspect of the invention, a DNA sequence provided to code for the polypeptide or fusion protein is not derived from native clostridial sequences, but is an artificially derived sequence not preexisting in nature.

A specific DNA (SEQ ID NO: 1) described in more detail below encodes a polypeptide or a fusion protein comprising nucleotides encoding residues 1-871 of a botulinum toxin type A. Said polypeptide comprises the light chain domain and the first 423 amino acid residues of the amino terminal portion of a botulinum toxin type A heavy chain. This recombinant product is designated $LH_{423}/A$ (SEQ ID NO: 2).

In a second embodiment of this aspect of the invention a DNA sequence which codes for the polypeptide or fusion protein is derived from native clostridial sequences but codes for a polypeptide or fusion protein not found in nature.

A specific DNA (SEQ ID NO: 19) described in more detail below encodes a polypeptide or a fusion protein and comprises nucleotides encoding residues 1-1171 of a botulinum toxin type B. Said polypeptide comprises the light chain domain and the first 728 amino acid residues of the amino terminal protein of a botulinum type B heavy chain. This recombinant product is designated $LH_{728}/B$ (SEQ ID NO: 20).

The invention thus also provides a method of manufacture of a polypeptide comprising expressing in a host cell a DNA according to the third aspect of the invention. The host cell is suitably not able to cleave a polypeptide or fusion protein of the invention so as to separate light and heavy toxin chains; for example, a non-clostridial host.

The invention further provides a method of manufacture of a polypeptide comprising expressing in a host cell a DNA encoding a fusion protein as described above, purifying the fusion protein by elution through a chromatography column adapted to retain the fusion protein, eluting through said chromatography column a ligand adapted to displace the fusion protein and recovering the fusion protein. Production of substantially pure fusion protein is thus made possible. Likewise, the fusion protein is readily cleaved to yield a polypeptide of the invention, again in substantially pure form, as the second polypeptide may conveniently be removed using the same type of chromatography column.

The $LH_N/A$ derived from dichain native toxin requires extended digestion with trypsin to remove the C-terminal ½ of the heavy chain, the $H_C$ domain. The loss of this domain effectively renders the toxin inactive in vivo by preventing its interaction with host target cells. There is, however, a residual toxic activity which may indicate a contaminating, trypsin insensitive, form of the whole type A neurotoxin.

In contrast, the recombinant preparations of the invention are the product of a discreet, defined gene coding sequence and can not be contaminated by full length toxin protein. Furthermore, the product as recovered from E. coli, and from other recombinant expression hosts, is an inactive single chain peptide or if expression hosts produce a processed, active polypeptide it is not a toxin. Endopeptidase activity of $LH_{423}/A$, as assessed by the current in vitro peptide cleavage assay, is wholly dependent on activation of the recombinant molecule between residues 430 and 454 by trypsin. Other proteolytic enzymes that cleave between these two residues are generally also suitable for activation of the recombinant molecule. Trypsin cleaves the peptide bond C-terminal to Arginine or C-terminal to Lysine and is suitable as these residues are found in the 430-454 region and are exposed (see FIG. 12).

The recombinant polypeptides of the invention are potential therapeutic agents for targeting to cells expressing the relevant substrate but which are not implicated in effecting botulism. An example might be where secretion of neurotransmitter is inappropriate or undesirable or alternatively where a neuronal cell is hyperactive in terms of regulated secretion of substances other than neurotransmitter. In such an example the function of the $H_C$ domain of the native toxin could be replaced by an alternative targeting sequence providing, for example, a cell receptor ligand and/or translocation domain.

One application of the recombinant polypeptides of the invention will be as a reagent component for synthesis of therapeutic molecules, such as disclosed in WO-A-94/21300. The recombinant product will also find application as a non-toxic standard for the assessment and development of in vitro assays for detection of functional botulinum or tetanus neurotoxins either in foodstuffs or in environmental samples, for example as disclosed in EP-A-0763131.

A further option is addition, to the C-terminal end of a polypeptide of the invention, of a peptide sequence which allows specific chemical conjugation to targeting ligands of both protein and non-protein origin.

In yet a further embodiment an alternative targeting ligand is added to the N-terminus of polypeptides of the invention. Recombinant $LH_N$ derivatives have been designated that have specific protease cleavage sites engineered at the C-terminus of the LC at the putative trypsin sensitive region and also at the extreme C-terminus of the complete protein product. These sites will enhance the activational specificity of the recombinant product such that the dichain species can only be activated by proteolytic cleavage of a more predictable nature than use of trypsin.

The $LH_N$ enzymatically produced from native BoNT/A is an efficient immunogen and thus the recombinant form with its total divorce from any full length neurotoxin represents a vaccine component. The recombinant product may serve as a basal reagent for creating defined protein modifications in support of any of the above areas.

Recombinant constructs are assigned distinguishing names on the basis of their amino acid sequence length and their Light Chain (L-chain, L) and Heavy Chain (H-chain, H) content as these relate to translated DNA sequences in the public domain or specifically to SEQ ID NO: 2 and SEQ ID NO: 20. The 'LH' designation is followed by '/X' where 'X' denotes the corresponding clostridial toxin serotype or class, e.g. 'A' for botulinum neurotoxin type A or 'TeTx' for tetanus toxin. Sequence variants from that of the native toxin polypeptide are given in parenthesis in standard format, namely the residue position number prefixed by the residue of the native sequence and suffixed by the residue of the variant.

Subscript number prefixes indicate an amino-terminal (N-terminal) extension, or where negative a deletion, to the translated sequence. Similarly, subscript number suffixes indicate a carboxy terminal (C-terminal) extension or where negative numbers are used, a deletion. Specific sequence inserts such as protease cleavage sites are indicated using abbreviations, e.g. Factor Xa is abbreviated to FXa. L-chain C-terminal suffixes and H-chain N-terminal prefixes are separated by a '/' to indicate the predicted junction between the L and H-chains. Abbreviations for engineered ligand sequences are prefixed or suffixed to the clostridial L-chain or H-chain corresponding to their position in the translation product.

Following this nomenclature,

LH$_{423}$/A=SEQ ID NO: 2, containing the entire L-chain and 423 amino acids of the H-chain of botulinum neurotoxin type A;

$_2$LH$_{423}$/A=a variant of this molecule, containing a two amino acid extension to the N-terminus of the L-chain;

$_2$L$_{/2}$H$_{423}$/A=a further variant in which the molecule contains a two amino acid extension on the N-terminus of both the L-chain and the H-chain;

$_2$L$_{FXa/2}$H$_{423}$/A=a further variant containing a two amino acid extension to the N-terminus of the L-chain, and a Factor Xa cleavage sequence at the C-terminus of the L-chain which, after cleavage of the molecule with Factor Xa leaves a two amino acid N-terminal extension to the H-chain component; and $_2$L$_{FXa/2}$H$_{423}$/A-IGF-1=a variant of this molecule which has a further C-terminal extension to the H-chain, in this example the insulin-like growth factor 1 (IGF-1) sequence.

The basic molecular biology techniques required to carry out the present invention were readily available in the art before the priority date of the present application and, as such, would be routine to a skilled person.

Example 1 of the present application illustrates conventional restriction endonuclease-dependent cleavage and ligation methodologies for preparing nucleic acid sequences encoding polypeptides of the present invention.

Example 4 et seq illustrate a number of alternative conventional methods for engineering recombinant DNA molecules that do not require traditional methods of restriction endonuclease-dependent cleavage and ligation of DNA. One such method is the site-specific recombination GATEWAY (trade mark) cloning system of Invitrogen, Inc., which uses phage lambda-based site-specific recombination [Landy, A. (1989) Ann. Rev. Biochem. 58, pp. 913-949]. This method is now described in slightly more detail.

Using standard restriction endonuclease digestion, or polymerase chain reaction techniques, a DNA sequence encoding first and second domains (eg. a BoNT LH$_N$ molecule) may be cloned into an Entry Vector. There are a number of options for creation of the correct coding region flanked by requisite att site recombination sequences, as described in the GATEWAY (trade mark) manual.

For example, one route is to insert a generic polylinker into the Entry Vector, in which the inserted DNA contains two att sites separated by the polylinker sequence. This approach facilitates insertion of a variety of fragments into the Entry Vector, at user-defined restriction endonuclease sites.

A second route is to insert att sites into the primers used for amplification of the DNA of interest. In this approach, the DNA sequence of the amplified fragment is modified to include the appropriate att sites at the 5' and 3' ends.

Examples of Entry Vectors are provided for LH$_N$/C (SEQ ID 135), for LH$_N$/C with no STOP codon thereby facilitating direct fusion to ligands (SEQ ID 136), and for a L-chain/C sequence that can facilitate combination with an appropriate second or third domain (SEQ ID 134).

By combination of the modified Entry Vector (containing the DNA of interest) and a Destination Vector of choice, an expression clone is generated. The Destination Vector typically provides the necessary information to facilitate transcription of the inserted DNA of interest and, when introduced into an appropriate host cell, facilitates expression of protein.

Destination Vectors may be prepared to ensure expression of N-terminal and/or C-terminal fusion tags and/or additional protein domains. An example of a novel engineered Destination Vector for the expression of MBP-tagged proteins in a non-transmissible vector backbone is presented in SEQ ID 137. In this specific embodiment, recombination of an Entry Vector possessing a sequence of interest with the Destination vector identified in SEQ ID 137 results in an expression vector for *E. coli* expression.

The combination of Entry and Destination Vectors to prepare an expression clone results in an expressed protein that has a modified sequence. In the Examples illustrated with SEQ ID 30 & 124, a peptide sequence of TSLYKKAGF is to be found at the N-terminus of the endopeptidase following cleavage to remove the purification tag. This peptide sequence is encoded by the DNA that forms the att site and is a feature of all clones that are constructed and expressed in this way.

It will be appreciated that the att site sequence may be modified to insert DNA encoding a specific protease cleavage site (for example from Table 1) to the 3' of the att site of the entry clone.

It will be also appreciated that the precise N-terminus of any polypeptide (eg. a LH$_N$ fragment) will vary depending on how the endopeptidase DNA was introduced into the entry vector and its relationship to the 5' att site. SEQ ID 29/30 & 123/124 are a case in point. The N-terminal extension of SEQ ID 30 is TSLYKKAGFGS whereas the N-terminal extension of SEQ ID 124 is ITSLYKKAGFGSLDH. These amino acid extension-containing domains provide further examples of first/second domain variants according to the present invention.

There now follows description of specific embodiments of the invention, illustrated by drawings in which:

FIG. 5 shows the transition region of an embodiment of the invention designated L/$_4$H$_{423}$/A illustrating insertion of four amino acids at the N-terminus of the H$_N$ sequence; amino acids coded for by the Eco 47 III restriction endonuclease cleavage site are marked and the H$_N$ sequence then begins ALN . . . ;

FIG. 6 shows the transition region of an embodiment of the invention designated L$_{FXa/3}$H$_{423}$/A illustrating insertion of a Factor Xa cleavage site at the C-terminus of the L-chain, and three additional amino acids coded for at the N-terminus of the H-sequence; the N-terminal amino acid of the cleavage-activated H$_N$ will be cysteine;

FIG. 7 shows the C-terminal portion of the amino acid sequence of an embodiment of the invention designated L$_{FXa/3}$H$_{423}$/A-IGF-1, a fusion protein; the IGF-1 sequence begins at position G$_{882}$;

FIG. 8 shows the C-terminal portion of the amino acid sequence of an embodiment of the invention designated L$_{FXa/3}$H$_{423}$/A-CtxA14, a fusion protein; the C-terminal CtxA sequence begins at position Q$_{882}$;

FIG. 9 shows the C-terminal portion of the amino acid sequence of an embodiment of the invention designated $L_{FXa/3}H_{423}/A$-ZZ, a fusion protein; the C-terminal ZZ sequence begins at position $A_{890}$ immediately after a genenase recognition site (underlined);

Figure 10:
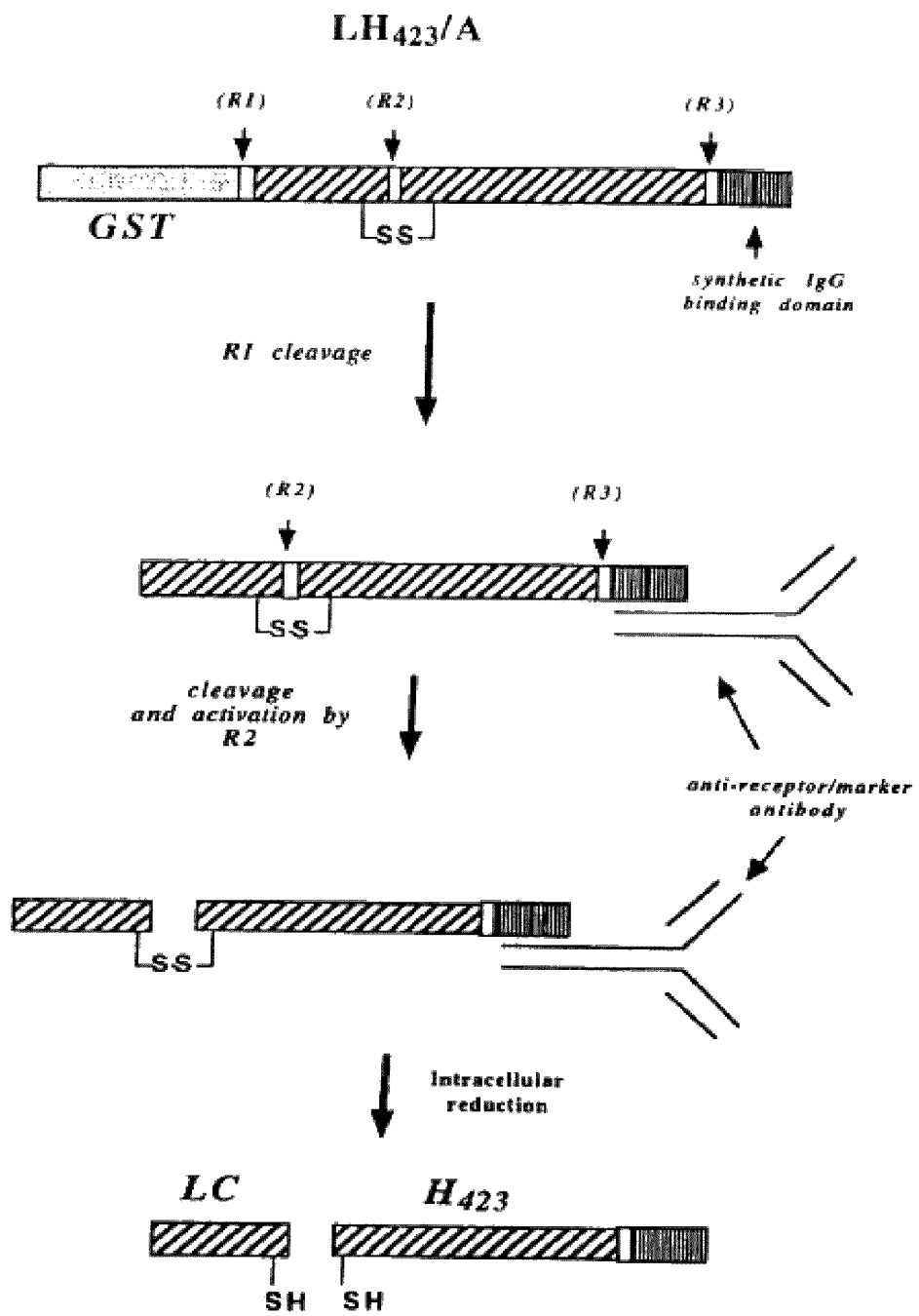
Figure 11:
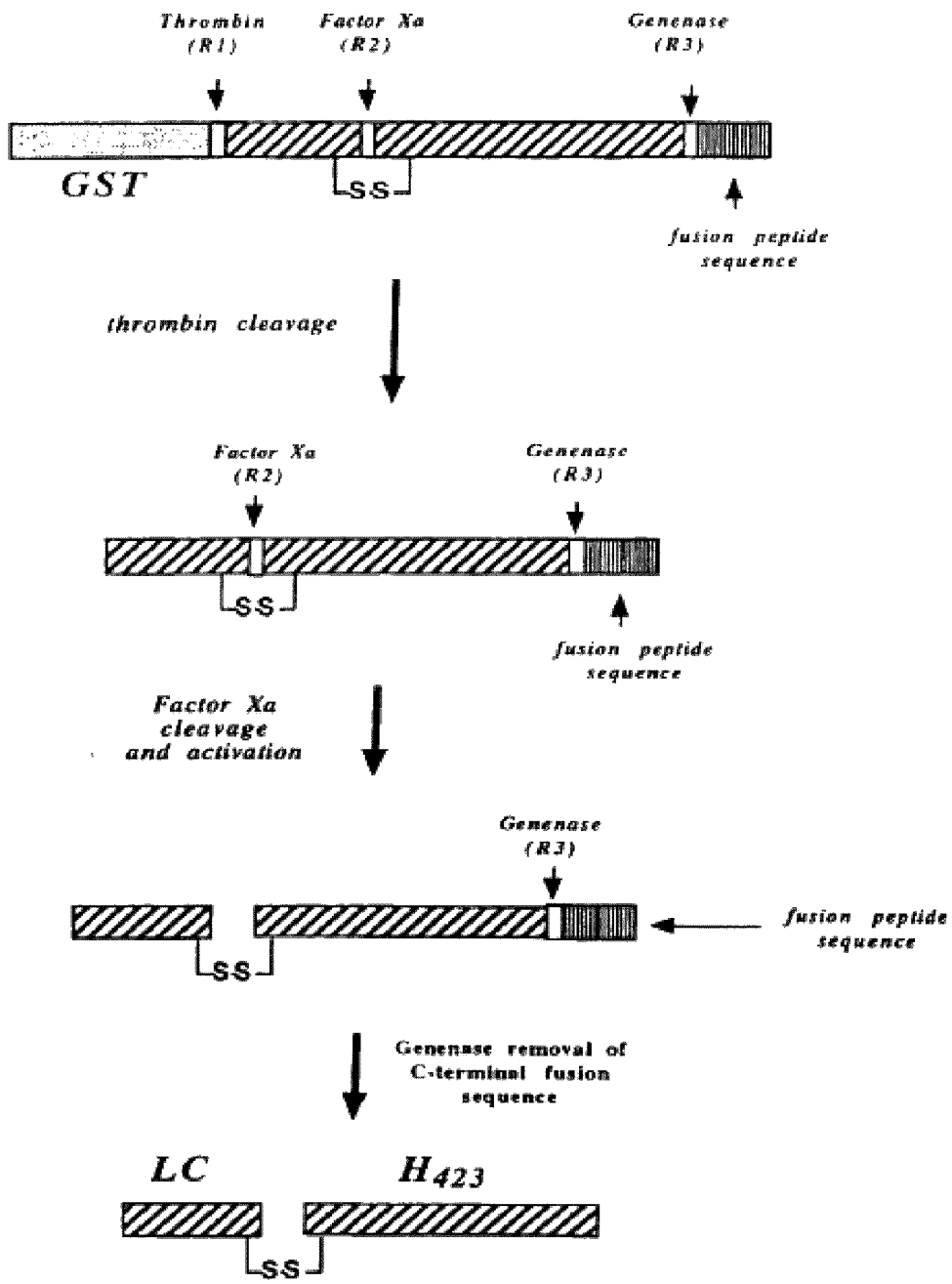
Figure 12:
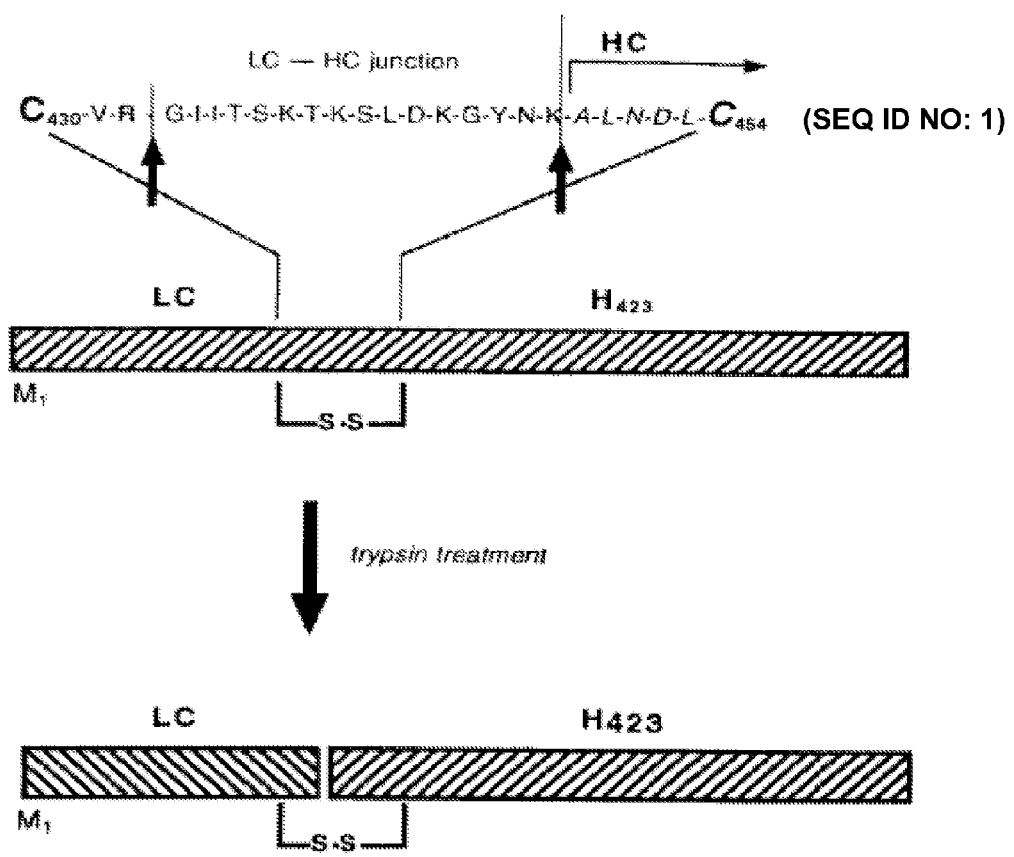

FIGS. 10 & 11 show schematic representations of manipulations of polypeptides of the invention; FIG. 10 shows $LH_{423}/A$ with N-terminal addition of an affinity purification peptide (in this case GST) and C-terminal addition of an Ig binding domain; protease cleavage sites R1, R2 and R3 enable selective enzymatic separation of domains; FIG. 11 shows specific examples of protease cleavage sites R1, R2 and R3 and a C-terminal fusion peptide sequence;

FIG. 12 shows the trypsin sensitive activation region of a polypeptide of the invention;

FIG. 13 shows Western blot analysis of recombinant $LH_{107}/B$ expressed from *E. coli*; panel A was probed with anti-BoNT/B antiserum; Lane 1, molecular weight standards; lanes 2 & 3, native BoNT/B; lane 4, immunopurified $LH_{107}/B$; panel B was probed with anti-T7 peptide tag antiserum; lane 1, molecular weight standards; lanes 2 & 3, positive control *E. coli* T7 expression; lane 4 immunopurified $LH_{107}/B$.

Figure 14:
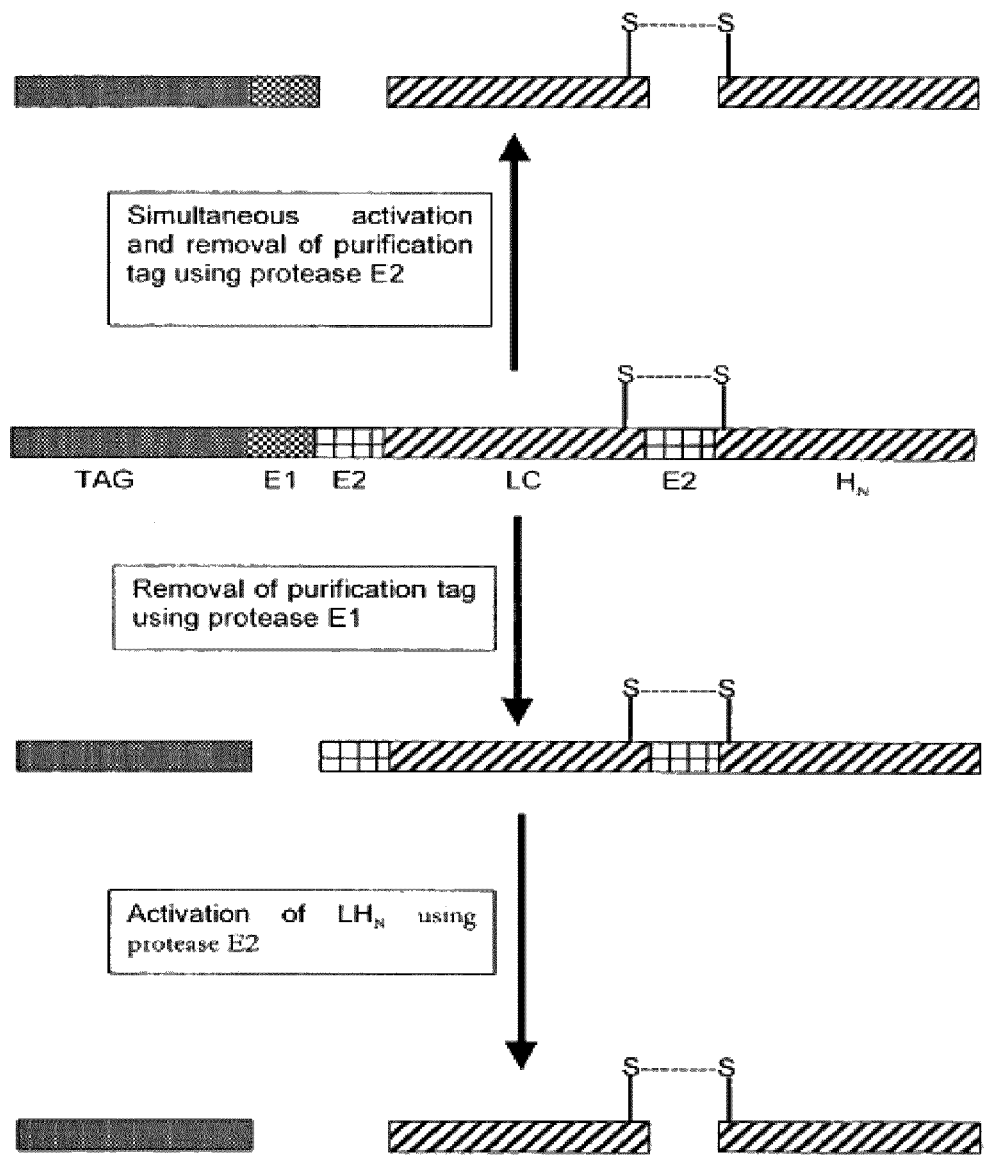

FIG. 14 illustrates a fusion protein of the present invention, which fusion protein includes two different proteolytic cleavage sites (E1, and E2) between a purification tag (TAG) and a first domain (L-chain), and a duplicate proteolytic cleavage sites (E2) between a first domain (L-chain) and a second domain ($H_N$). Use of the E2 protease results in simultaneous cleavage at the two defined E2 cleavage sites leaving a dichain polypeptide molecule comprising the first and second domains, whereas use of the E1 protease results in cleavage at the single defined E1 cleavage site leaving a single polypeptide chain molecule comprising the first and second domains.

Figure 15:
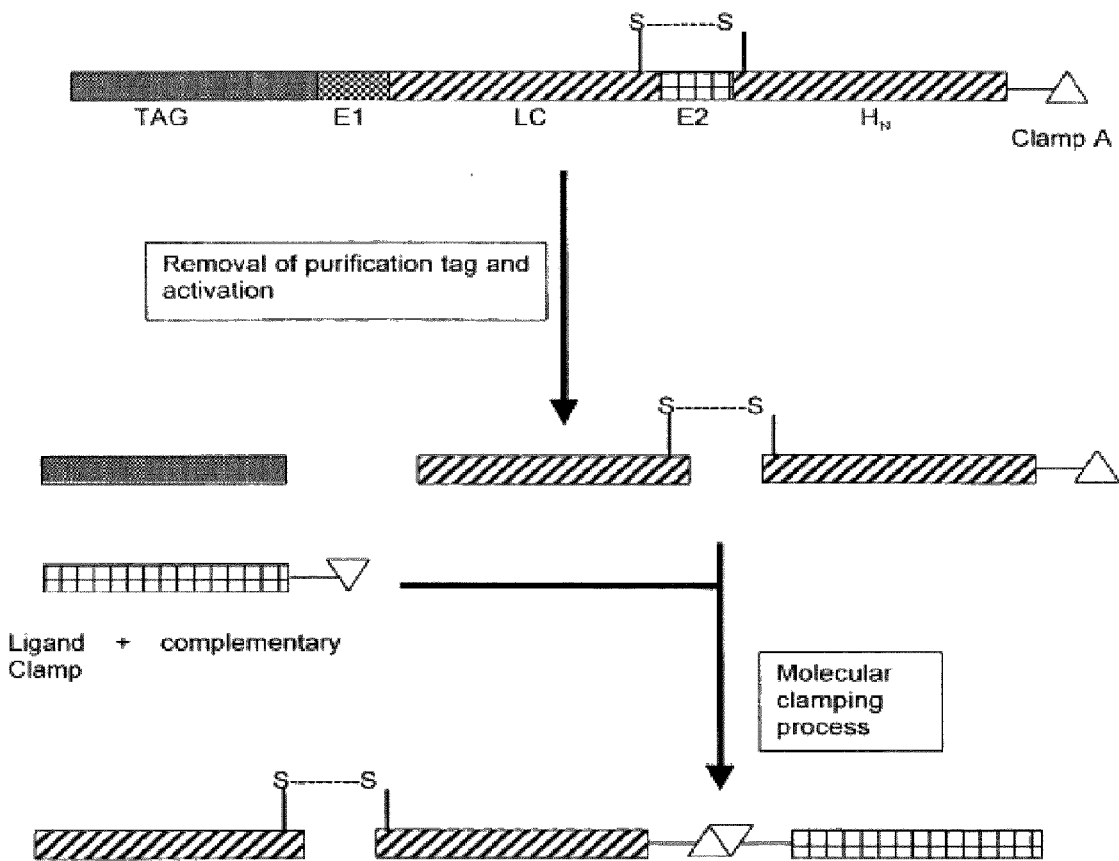

FIG. 15 illustrates the use of molecular-clamping technology to fuse together a polypeptide comprising first and second domains (eg. $LH_N$), and a second molecule comprising a third domain (eg. a ligand).

The sequence listing that accompanies this application contains the following sequences:—

Figure 4:
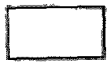
FIG. 4 is a comparison of the first 33 amino acids in published sequences of native toxin and embodiments of the invention.

| SEQ ID NO: | Sequence |
|---|---|
| 1 | DNA coding for $LH_{423}/A$ |
| 2 | $LH_{423}/A$ |
| 3 | DNA coding for $_{23}LH_{423}/A$ ($Q_2E,N_{26}K,A_{27}Y$), of which an N-terminal portion is shown in FIG. 4. |
| 4 | $_{23}LH_{423}/A$ ($Q_2E,N_{26}K,A_{27}Y$) |
| 5 | DNA coding for $_2LH_{423}/A$ ($Q_2E,N_{26}K,A_{27}Y$), of which an N-terminal portion is shown in FIG. 4 |
| 6 | $_2LH_{423}/A$ ($Q_2E,N_{26}K,A_{27}Y$) |
| 7 | DNA coding for native BoNT/A according to Binz et al |
| 8 | native BoNT/A according to Binz et al |
| 9 | DNA coding for $L_{/4}H_{423}/A$ |
| 10 | $L_{/4}H_{423}/A$ |
| 11 | DNA coding for $L_{FXa/3}H_{423}/A$ |
| 12 | $L_{FXa/3}H_{423}/A$ |
| 13 | DNA coding for $L_{FXa/3}H_{423}/A$-IGF-1 |
| 14 | $L_{FXa/3}H_{423}/A$-IGF-1 |
| 15 | DNA coding for $L_{FXa/3}H_{423}/A$-CtxA14 |
| 16 | $L_{FXa/3}H_{423}/A$-CtxA14 |
| 17 | DNA coding for $L_{FXa/3}H_{423}/A$-ZZ |
| 18 | $L_{FXa/3}H_{423}/A$-ZZ |
| 19 | DNA coding for $LH_{728}/B$ |
| 20 | $LH_{728}/B$ |
| 21 | DNA coding for $LH_{417}/B$ |
| 22 | $LH_{417}/B$ |
| 23 | DNA coding for $LH_{107}/B$ |
| 24 | $LH_{107}/B$ |

-continued

| SEQ ID NO: | Sequence |
|---|---|
| 25 | DNA coding for $LH_{423}/A$ ($Q_2E,N_{26}K,A_{27}Y$) |
| 26 | $LH_{423}/A$ ($Q_2E,N_{26}K,A_{27}Y$) |
| 27 | DNA coding for $LH_{417}/B$ wherein the first 274 bases are modified to have an E. coli codon bias |
| 28 | DNA coding for $LH_{417}/B$ wherein bases 691-1641 of the native BoNT/B sequence have been replaced by a degenerate DNA coding for amino acid residues 231-547 of the native BoNT/B polypeptide |
| 29 | DNA coding for $LH_N/A$ as expressed from a Gateway adapted destination vector. $LH_N/A$ incorporates an enterokinase activation site at the LC-$H_N$ junction and an 11 amino acid att site peptide extension at the 5' end of the $LH_N/A$ sequence |
| 30 | $LH_N/A$ produced by expression of SEQ ID 29, said polypeptide incorporating an enterokinase activation site at the LC-$H_N$ junction and an 11 amino acid att site peptide extension at the N-terminus of the $LH_N/A$ sequence |
| 31 | DNA coding for $LH_N/A$ with an enterokinase activation site at the LC-$H_N$ junction |
| 32 | $LH_N/A$ produced by expression of SEQ ID 31, said polypeptide having an enterokinase activation site at the LC-$H_N$ junction |
| 33 | DNA coding for $LH_N/A$ with a Factor Xa protease activation site at the LC-$H_N$ junction |
| 34 | $LH_N/A$ produced by expression of SEQ ID 33, said polypeptide having a Factor Xa protease activation site at the LC-$H_N$ junction |
| 35 | DNA coding for $LH_N/A$ with a Precission protease activation site at the LC-$H_N$ junction |
| 36 | $LH_N/A$ produced by expression of SEQ ID 35, said polypeptide having a Precission protease activation site at the LC-$H_N$ junction |
| 37 | DNA coding for $LH_N/A$ with a Thrombin protease activation site at the LC-$H_N$ junction |
| 38 | $LH_N/A$ produced by expression of SEQ ID 37, said polypeptide having a Thrombin protease activation site at the LC-$H_N$ junction |
| 39 | DNA coding for an $LH_N/A$-ligand (*Erythrina cristagalli* lectin) fusion in which the LC-$H_N$ junction does not incorporate a specific protease cleavage site and the ligand is spaced from the $H_N$ domain by a $(GGGGS)_3$ spacer. |
| 40 | $LH_N/A$-ligand (*Erythrina cristagalli* lectin) fusion produced by expression of SEQ ID 39, in which the LC-$H_N$ junction does not incorporate a specific protease cleavage site and the ligand is spaced from the $H_N$ domain by a $(GGGGS)_3$ spacer. |
| 41 | DNA coding for $LH_N/A$-ligand (*Erythrina cristagalli* lectin) fusion in which the LC-$H_N$ junction does not incorporate a specific protease cleavage site and the ligand is spaced from the $H_N$ domain by a helical spacer. |
| 42 | $LH_N/A$-ligand (*Erythrina cristagalli* lectin) fusion produced by expression of SEQ ID 41, in which the LC-$H_N$ junction does not incorporate a specific protease cleavage site and the ligand is spaced from the $H_N$ domain by a helical spacer. |
| 43 | DNA coding for $LH_N/A$-ligand (*Erythrina cristagalli* lectin) fusion in which the LC-$H_N$ junction incorporates a specific enterokinase protease activation site and the ligand is spaced from the $H_N$ domain by a $(GGGGS)_3$ spacer. |
| 44 | $LH_N/A$-ligand (*Erythrina cristagalli* lectin) fusion produced by expression of SEQ ID 43, in which the LC-$H_N$ junction incorporates a specific enterokinase protease activation site and the ligand is spaced from the $H_N$ domain by a $(GGGGS)_3$ spacer. |
| 45 | DNA coding for $LH_N/A$-ligand (*Erythrina cristagalli* lectin) fusion in which the LC-$H_N$ junction incorporates a specific enterokinase protease activation site and the ligand is spaced from the $H_N$ domain by a helical spacer. |
| 46 | $LH_N/A$-ligand (*Erythrina cristagalli* lectin) fusion produced by expression of SEQ ID 45, in which the LC-$H_N$ junction incorporates a specific enterokinase protease activation site and the ligand is spaced from the $H_N$ domain by a helical spacer. |

| SEQ ID NO: | Sequence |
|---|---|
| 47 | DNA coding for LH$_N$/A-ligand (*Erythrina cristagalli* lectin) fusion in which the LC-H$_N$ junction incorporates a specific Thrombin protease activation site and the ligand is spaced from the H$_N$ domain by a helical spacer. |
| 48 | LH$_N$/A-ligand (*Erythrina cristagalli* lectin) fusion produced by expression of SEQ ID 47, in which the LC-H$_N$ junction incorporates a specific Thrombin protease activation site and the ligand is spaced from the H$_N$ domain by a helical spacer. |
| 49 | DNA coding for LH$_N$/A-ligand (*Erythrina cristagalli* lectin) fusion in which the LC-H$_N$ junction incorporates a specific Thrombin protease activation site and the ligand is spaced from the H$_N$ domain by a (GGGGS)$_3$ spacer. |
| 50 | LH$_N$/A-ligand (*Erythrina cristagalli* lectin) fusion produced by expression of SEQ ID 49, in which the LC-H$_N$ junction incorporates a specific Thrombin protease activation site and the ligand is spaced from the H$_N$ domain by a (GGGGS)$_3$ spacer. |
| 51 | DNA coding for LH$_N$/A-ligand (*Erythrina cristagalli* lectin) fusion in which the LC-H$_N$ junction incorporates a specific Precission protease activation site and the ligand is spaced from the H$_N$ domain by a helical spacer. |
| 52 | LH$_N$/A-ligand (*Erythrina cristagalli* lectin) fusion produced by expression of SEQ ID 51, in which the LC-H$_N$ junction incorporates a specific Precission protease activation site and the ligand is spaced from the H$_N$ domain by a helical spacer. |
| 53 | DNA coding for LH$_N$/A-ligand (*Erythrina cristagalli* lectin) fusion in which the LC-H$_N$ junction incorporates a specific Precission protease activation site and the ligand is spaced from the H$_N$ domain by a (GGGGS)$_3$ spacer. |
| 54 | LH$_N$/A-ligand (*Erythrina cristagalli* lectin) fusion produced by expression of SEQ ID 53, in which the LC-H$_N$ junction incorporates a specific Precission protease activation site and the ligand is spaced from the H$_N$ domain by a (GGGGS)$_3$ spacer. |
| 55 | DNA coding for LH$_N$/A-ligand (*Erythrina cristagalli* lectin) fusion in which the LC-H$_N$ junction incorporates a specific Factor Xa protease activation site and the ligand is spaced from the H$_N$ domain by a helical spacer. |
| 56 | LH$_N$/A-ligand (*Erythrina cristagalli* lectin) fusion produced by expression of SEQ ID 55, in which the LC-H$_N$ junction incorporates a specific Factor Xa protease activation site and the ligand is spaced from the H$_N$ domain by a helical spacer. |
| 57 | DNA coding for LH$_N$/A-ligand (*Erythrina cristagalli* lectin) fusion in which the LC-H$_N$ junction incorporates a specific Factor Xa protease activation site and the ligand is spaced from the H$_N$ domain by a (GGGGS)$_3$ spacer. |
| 58 | LH$_N$/A-ligand (*Erythrina cristagalli* lectin) fusion produced by expression of SEQ ID 57, in which the LC-H$_N$ junction incorporates a specific Factor Xa protease activation site and the ligand is spaced from the H$_N$ domain by a (GGGGS)$_3$ spacer. |
| 59 | DNA coding for LH$_N$/A incorporating an enterokinase protease activation site at the LC-H$_N$ junction and a C-terminal fos ligand bounded by a pair of Cys residues |
| 60 | LH$_N$/A produced by expression of SEQ ID 59, said polypeptide incorporating an enterokinase protease activation site at the LC-H$_N$ junction and a C-terminal fos ligand bounded by a pair of Cys residues |
| 61 | DNA coding for LH$_N$/A incorporating an enterokinase protease activation site at the LC-H$_N$ junction and a C-terminal (Glu)$_8$ peptide bounded by a pair of Cys residues |
| 62 | LH$_N$/A produced by expression of SEQ ID 61, said polypeptide incorporating an enterokinase protease activation site at the LC-H$_N$ junction and a C-terminal (Glu)$_8$ peptide bounded by a pair of Cys residues |
| 63 | DNA coding for LH$_N$/A incorporating an enterokinase protease activation site at the LC-H$_N$ junction and a C-terminal fos ligand |
| 64 | LH$_N$/A produced by expression of SEQ ID 63, said polypeptide incorporating an enterokinase protease activation site at the LC-H$_N$ junction and a C-terminal fos ligand |
| 65 | DNA coding for LH$_N$/A incorporating an enterokinase protease activation site at the LC-H$_N$ junction and a C-terminal (Glu)$_8$ peptide |
| 66 | LH$_N$/A produced by expression of SEQ ID 65, said polypeptide incorporating an enterokinase protease activation site at the LC-H$_N$ junction and a C-terminal (Glu)$_8$ peptide |
| 67 | DNA coding for LH$_N$/A incorporating an enterokinase protease activation site at the LC-H$_N$ junction and a C-terminal self-cleavable intein polypeptide to facilitate thioester formation for use in chemical directed coupling |
| 68 | LH$_N$/A produced by expression of SEQ ID 67, said polypeptide incorporating an enterokinase protease activation site at the LC-H$_N$ junction and a C-terminal self-cleavable intein polypeptide to facilitate thioester formation for use in chemical directed coupling |
| 69 | DNA coding for LC/A with no STOP codon, a linker peptide incorporating the first 6 amino acids of the H$_N$ domain and an enterokinase cleavage site. |
| 70 | LC/A produced by expression of SEQ ID 69, said polypeptide having no STOP codon, a linker peptide incorporating the first 6 amino acids of the H$_N$ domain and an enterokinase cleavage site. |
| 71 | DNA coding for LC/A with no STOP codon, a linker peptide incorporating the first 6 amino acids of the H$_N$ domain and an Factor Xa cleavage site. |
| 72 | LC/A produced by expression of SEQ ID 71, said polypeptide having no STOP codon, a linker peptide incorporating the first 6 amino acids of the H$_N$ domain and an Factor Xa cleavage site. |
| 73 | DNA coding for LC/A with no STOP codon and a linker peptide representing the native LC-H$_N$ sequence incorporating the first 6 amino acids of the H$_N$ domain |
| 74 | LC/A produced by expression of SEQ ID 73, said polypeptide having no STOP codon and a linker peptide representing the native LC-H$_N$ sequence incorporating the first 6 amino acids of the H$_N$ domain |
| 75 | DNA coding for LC/A with no STOP codon, a linker peptide incorporating the first 6 amino acids of the H$_N$ domain and an Precission cleavage site. |
| 76 | LC/A produced by expression of SEQ ID 75, said polypeptide having no STOP codon, a linker peptide incorporating the first 6 amino acids of the H$_N$ domain and an Precission cleavage site. |
| 77 | DNA coding for LC/A with no STOP codon, a linker peptide incorporating the first 6 amino acids of the H$_N$ domain and an Thrombin cleavage site. |
| 78 | LC/A produced by expression of SEQ ID 77, said polypeptide having no STOP codon, a linker peptide incorporating the first 6 amino acids of the H$_N$ domain and an Thrombin cleavage site. |
| 79 | DNA coding for LH$_N$/B incorporating an enterokinase protease activation site at the LC-H$_N$ junction (in which there are 11 amino acids between the Cys residues of the LC & H$_N$ domains) and a 6 amino acid N-terminal extension |
| 80 | LH$_N$/B produced by expression of SEQ ID 79, said polypeptide incorporating an enterokinase protease activation site at the LC-H$_N$ junction (in which there are 11 amino acids between the Cys residues of the LC & H$_N$ domains) and a 6 amino acid N-terminal extension |
| 81 | DNA coding for LH$_N$/B incorporating an enterokinase protease activation site at the LC-H$_N$ junction (in which there are 20 amino acids between the Cys residues of the LC & H$_N$ domains) and a 6 amino acid N-terminal extension |
| 82 | LH$_N$/B produced by expression of SEQ ID 82, said polypeptide incorporating an enterokinase protease activation site at the LC-H$_N$ junction (in which there are 20 amino acids between the Cys residues of the LC & H$_N$ domains) and a 6 amino acid N-terminal extension |
| 83 | DNA coding for LH$_N$/B incorporating a Factor Xa protease activation site at the LC-H$_N$ junction and an 11 amino acid N-terminal extension resulting from cleavage at an intein self-cleaving polypeptide |
| 84 | LH$_N$/B produced by expression of SEQ ID 83, said polypeptide incorporating a Factor Xa protease activation |

| SEQ ID NO: | Sequence |
|---|---|
| | site at the LC-$H_N$ junction and an 11 amino acid N-terminal extension resulting from cleavage at an intein self-cleaving polypeptide |
| 85 | DNA coding for $LH_N$/B incorporating a Factor Xa protease activation site at the LC-$H_N$ junction and an 11 amino acid N-terminal extension (retaining a Factor Xa protease cleavage site) resulting from cleavage at a TEV protease cleavage site (included to release the $LH_N$/B from a purification tag). |
| 86 | $LH_N$/B produced by expression of SEQ ID 85, said polypeptide incorporating a Factor Xa protease activation site at the LC-$H_N$ junction and an 11 amino acid N-terminal extension (retaining a Factor Xa protease cleavage site) resulting from cleavage at a TEV protease cleavage site (included to release the $LH_N$/B from a purification tag). |
| 87 | DNA coding for $LH_N$/B incorporating a Factor Xa protease activation site at the LC-$H_N$ junction and a 6 amino acid N-terminal extension |
| 88 | $LH_N$/B produced by expression of SEQ ID 87, said polypeptide incorporating a Factor Xa protease activation site at the LC-$H_N$ junction and a 6 amino acid N-terminal extension |
| 89 | DNA coding for $LH_N$/B incorporating a Factor Xa protease activation site at the LC-$H_N$ junction and an 11 amino acid N-terminal extension (retaining an enterokinase protease cleavage site) resulting from cleavage at a Factor Xa protease cleavage site (included to release the $LH_N$/B from a purification tag). |
| 90 | $LH_N$/B produced by expression of SEQ ID 89, said polypeptide incorporating a Factor Xa protease activation site at the LC-$H_N$ junction and an 11 amino acid N-terminal extension (retaining an enterokinase protease cleavage site) resulting from cleavage at a Factor Xa protease cleavage site (included to release the $LH_N$/B from a purification tag). |
| 91 | DNA coding for $LH_N$/B incorporating a Factor Xa protease activation site at the LC-$H_N$ junction and an 10 amino acid N-terminal extension (retaining a Factor Xa protease cleavage site) resulting from cleavage at an enterokinase protease cleavage site (included to release the $LH_N$/B from a purification tag). |
| 92 | $LH_N$/B produced by expression of SEQ ID 91, said polypeptide incorporating a Factor Xa protease activation site at the LC-$H_N$ junction and an 10 amino acid N-terminal extension (retaining a Factor Xa protease cleavage site) resulting from cleavage at an enterokinase protease cleavage site (included to release the $LH_N$/B from a purification tag). |
| 93 | DNA coding for $LH_N$/B incorporating a Factor Xa protease activation site at the LC-$H_N$ junction and a 2 amino acid (Gly-Ser) N-terminal extension as expressed in pGEX-4T-2 |
| 94 | $LH_N$/B produced by expression of SEQ ID 93, said polypeptide incorporating a Factor Xa protease activation site at the LC-$H_N$ junction and a 2 amino acid (Gly-Ser) N-terminal extension as expressed in pGEX-4T-2 |
| 95 | DNA coding for $LH_N$/B incorporating a Factor Xa protease activation site at the LC-$H_N$ junction and a 7 amino acid (Ser-Pro-Gly-Ala-Arg-Gly-Ser) N-terminal extension as expressed in pET-43a |
| 96 | $LH_N$/B produced by expression of SEQ ID 95, said polypeptide incorporating a Factor Xa protease activation site at the LC-$H_N$ junction and a 7 amino acid (Ser-Pro-Gly-Ala-Arg-Gly-Ser) N-terminal extension as expressed in pET-43a |
| 97 | DNA coding for $LH_N$/B incorporating a Factor Xa protease activation site at the LC-$H_N$ junction and a 7 amino acid (Ala-Met-Ala-Glu-Ile-Gly-Ser) N-terminal extension as expressed in pET-32a |
| 98 | $LH_N$/B produced by expression of SEQ ID 97, said polypeptide incorporating a Factor Xa protease activation site at the LC-$H_N$ junction and a 7 amino acid (Ala-Met-Ala-Asp-Ile-Gly-Ser) N-terminal extension as expressed in pET-32a |
| 99 | DNA coding for $LH_N$/B incorporating a Thrombin protease activation site at the LC-$H_N$ junction and a 6 amino acid (Ile-Ser-Glu-Phe-Gly-Ser) N-terminal extension as expressed in pMAL-c2 |
| 100 | $LH_N$/B produced by expression of SEQ ID 99, said polypeptide incorporating a Thrombin protease activation site at the LC-$H_N$ junction and a 6 amino acid (Ile-Ser-Glu-Phe-Gly-Ser) N-terminal extension as expressed in pMAL-c2 |
| 101 | DNA coding for $LH_N$/B incorporating a TEV protease activation site at the LC-$H_N$ junction and a 6 amino acid (Ile-Ser-Glu-Phe-Gly-Ser) N-terminal extension as expressed in pMAL-c2 |
| 102 | $LH_N$/B produced by expression of SEQ ID 101, said polypeptide incorporating a TEV protease activation site at the LC-$H_N$ junction and a 6 amino acid (Ile-Ser-Glu-Phe-Gly-Ser) N-terminal extension as expressed in pMAL-c2 |
| 103 | DNA coding for $LH_N$/B incorporating a Factor Xa protease activation site at the LC-$H_N$ junction and a 6 amino acid (Ile-Ser-Glu-Phe-Gly-Ser) N-terminal extension as expressed in pMAL-c2. DNA incorporates MfeI and AvrII restriction enzyme sites for incorporation of novel linker sequences at the LC-$H_N$ junction. |
| 104 | $LH_N$/B produced by expression of SEQ ID 103, said polypeptide incorporating a Factor Xa protease activation site at the LC-$H_N$ junction and a 6 amino acid (Ile-Ser-Glu-Phe-Gly-Ser) N-terminal extension as expressed in pMAL-c2. |
| 105 | DNA coding for $LH_N$/B incorporating an enterokinase protease activation site at the LC-$H_N$ junction (in which there are 20 amino acids between the Cys residues of the LC & $H_N$ domains) and a 6 amino acid (Ile-Ser-Glu-Phe-Gly-Ser) N-terminal extension. AvrII restriction site is deleted. |
| 106 | $LH_N$/B produced by expression of SEQ ID 105, said polypeptide incorporating an enterokinase protease activation site at the LC-$H_N$ junction (in which there are 20 amino acids between the Cys residues of the LC & $H_N$ domains) and a 6 amino acid (Ile-Ser-Glu-Phe-Gly-Ser) N-terminal extension |
| 107 | DNA coding for $LH_N$/B incorporating an enterokinase protease activation site at the LC-$H_N$ junction (in which there are 20 amino acids between the Cys residues of the LC & $H_N$ domains) and a 6 amino acid (Ile-Ser-Glu-Phe-Gly-Ser) N-terminal extension. |
| 108 | $LH_N$/B produced by expression of SEQ ID 107, said polypeptide incorporating an enterokinase protease activation site at the LC-$H_N$ junction (in which there are 20 amino acids between the Cys residues of the LC & $H_N$ domains) and a 6 amino acid (Ile-Ser-Glu-Phe-Gly-Ser) N-terminal extension. |
| 109 | DNA coding for a maltose-binding protein-Factor Xa-intein-LC/B-Factor Xa-$H_N$ expression construct. |
| 110 | MBP-$LH_N$/B produced by expression of SEQ ID 109, said polypeptide incorporating a self-cleavable intein sequence to facilitate removal of the MBP purification tag and a Factor Xa protease activation site at the LC-$H_N$ junction |
| 111 | DNA coding for $LH_N$/B incorporating an enterokinase protease activation site at the LC-$H_N$ junction (in which there are 11 amino acids between the Cys residues of the LC & $H_N$ domains) and an 11 amino acid (Thr-Ser-Leu-Tyr-Lys-Lys-Ala-Gly-Phe-Gly-Ser) N-terminal extension derived from the att site adaptation of the vector. This construct has the C-terminal STOP codon removed to facilitate direct fusion of fragment and ligands. |
| 112 | $LH_N$/B produced by expression of SEQ ID 111, said polypeptide incorporating an enterokinase protease activation site at the LC-$H_N$ junction (in which there are 11 amino acids between the Cys residues of the LC & $H_N$ domains) and an 11 amino acid (Thr-Ser-Leu-Tyr-Lys-Lys-Ala-Gly-Phe-Gly-Ser) N-terminal extension derived from the att site adaptation of the vector. |
| 113 | DNA coding for LC/B with no STOP codon, a linker peptide incorporating the first 6 amino acids of the $H_N$ domain and an enterokinase protease cleavage site bounded by Cys residues |
| 114 | LC/B produced by expression of SEQ ID 113, said polypeptide having no STOP codon, a linker peptide incorporating the first 6 amino acids of the $H_N$ domain and an enterokinase protease cleavage site bounded by Cys residues |

| SEQ ID NO: | Sequence |
|---|---|
| 115 | DNA coding for LH$_N$/C incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal (Glu)$_8$ peptide to facilitate molecular clamping. |
| 116 | LH$_N$/C produced by expression of SEQ ID 115, said polypeptide incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal (Glu)$_8$ peptide to facilitate molecular clamping. |
| 117 | DNA coding for LH$_N$/C incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal fos ligand bounded by a pair of Cys residues to facilitate molecular clamping. |
| 118 | LH$_N$/C produced by expression of SEQ ID 117, said polypeptide incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal fos ligand bounded by a pair of Cys residues to facilitate molecular clamping. |
| 119 | DNA coding for LH$_N$/C incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal (Glu)$_8$ peptide bounded by a pair of Cys residues to facilitate molecular clamping |
| 120 | LH$_N$/C produced by expression of SEQ ID 119, said polypeptide incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal (Glu)$_8$ peptide bounded by a pair of Cys residues to facilitate molecular clamping |
| 121 | DNA coding for LH$_N$/C incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal fos ligand to facilitate molecular clamping. |
| 122 | LH$_N$/C produced by expression of SEQ ID 121, said polypeptide incorporating a Factor Xa cleavage site at the LC-H$_N$ junction, an 11 amino acid (Thr-Ser-Leu-Tyr-Lys-Lys-Ala-Gly-Phe-Gly-Ser) N-terminal extension derived from the att site adaptation of the vector, and a C-terminal fos ligand to facilitate molecular clamping |
| 123 | DNA coding for LH$_N$/C incorporating a Factor Xa cleavage site at the LC-H$_N$ junction, an 15 amino acid (Ile-Thr-Ser-Leu-Tyr-Lys-Lys-Ala-Gly-Phe-Gly-Ser-Leu-Asp-His) N-terminal extension derived from the att site adaptation of the vector. |
| 124 | LH$_N$/C produced by expression of SEQ ID 123, said polypeptide incorporating a Factor Xa cleavage site at the LC-H$_N$ junction, a 15 amino acid (Ile-Thr-Ser-Leu-Tyr-Lys-Lys-Ala-Gly-Phe-Gly-Ser-Leu-Asp-His) N-terminal extension derived from the att site adaptation of the vector. |
| 125 | DNA coding for LH$_N$/C incorporating a Factor Xa cleavage site at the LC-H$_N$ junction and an 11 amino acid (Val-Pro-Glu-Phe-Gly-Ser-Ser-Arg-Val-Asp-His) N-terminal extension derived following cleavage of the protein with enterokinase |
| 126 | LH$_N$/C produced by expression of SEQ ID 125, said polypeptide incorporating a Factor Xa cleavage site at the LC-H$_N$ junction and an11 amino acid (Val-Pro-Glu-Phe-Gly-Ser-Ser-Arg-Val-Asp-His) N-terminal extension derived following cleavage of the protein with enterokinase to release the N-terminal MBP purification tag. |
| 127 | DNA coding for LH$_N$/C incorporating a Factor Xa cleavage site at the LC-H$_N$ junction and an 10 amino acid (Val-Glu-Phe-Gly-Ser-Ser-Arg-Val-Asp-His) N-terminal extension derived following cleavage of the protein with genenase |
| 128 | LH$_N$/C produced by expression of SEQ ID 127, said polypeptide incorporating a Factor Xa cleavage site at the LC-H$_N$ junction and an 10 amino acid (Val-Glu-Phe-Gly-Ser-Ser-Arg-Val-Asp-His) N-terminal extension derived following cleavage of the protein with genenase to release the N-terminal MBP purification tag |
| 129 | DNA coding for LH$_N$/C incorporating a Factor Xa cleavage site at the LC-H$_N$ junction and an 11 amino acid (Ile-Ser-Glu-Phe-Gly-Ser-Ser-Arg-Val-Asp-His) N-terminal extension derived following cleavage of the protein with Factor Xa |
| 130 | LH$_N$/C produced by expression of SEQ ID 129, said polypeptide incorporating a Factor Xa cleavage site at the LC-H$_N$ junction and an 11 amino acid (Ile-Ser-Glu-Phe-Gly-Ser-Ser-Arg-Val-Asp-His) N-terminal extension derived following cleavage of the protein with Factor Xa |
| 131 | DNA coding for LH$_N$/C incorporating a Factor Xa cleavage site at the LC-H$_N$ junction, a 15 amino acid (Ile-Thr-Ser-Leu-Tyr-Lys-Lys-Ala-Gly-Phe-Gly-Ser-Leu-Asp-His) N-terminal extension and a 21 amino acid (Leu-Gln-Thr-Leu-Asp-Asp-Pro-Ala-Phe-Leu-Tyr-Lys-Val-Val-Ile-Phe-Gln-Asn-Ser-Asp-Pro) C-terminal extension derived from the att site adaptation of the vector. The clone has no STOP codon in order to facilitate fusion of ligands onto C-terminus of H$_N$ domain. |
| 132 | LH$_N$/C produced by expression of SEQ ID 131, said polypeptide incorporating a Factor Xa cleavage site at the LC-H$_N$ junction, a 15 amino acid (Ile-Thr-Ser-Leu-Tyr-Lys-Lys-Ala-Gly-Phe-Gly-Ser-Leu-Asp-His) N-terminal extension and a 21 amino acid (Leu-Gln-Thr-Leu-Asp-Asp-Pro-Ala-Phe-Leu-Tyr-Lys-Val-Val-Ile-Phe-Gln-Asn-Ser-Asp-Pro) C-terminal extension derived from the att site adaptation of the vector. The clone has no STOP codon in order to facilitate fusion of ligands onto C-terminus of H$_N$ domain. |
| 133 | DNA coding for LH$_N$/C incorporating a Factor Xa cleavage site at the LC-H$_N$ junction, an N-terminal extension and a C-terminal extension derived from the att site adaptation of the vector. The clone has no STOP codon in order to facilitate fusion of ligands onto C-terminus of H$_N$ domain. |
| 134 | DNA coding for LC/C as prepared in pENTRY2 for use in the Gateway site specific recombination cloning system. LC/C has no STOP codon in order to facilitate creation of LC-H$_N$ fusions through recombination. |
| 135 | DNA coding for LH$_N$/C as prepared in pENTRY2 for use in the Gateway site specific recombination cloning system. LH$_N$/C has a STOP codon and is thus in the correct format for recombination into an appropriate destination vector. |
| 136 | DNA coding for LH$_N$/C as prepared in pENTRY2 for use in the Gateway site specific recombination cloning system. LH$_N$/C has no STOP codon in order to facilitate creation of LH$_N$/C-ligand fusions through recombination. |
| 137 | DNA sequence of a pMTL vector modified to be a suitable destination vector in which to insert endopeptidase fragments from entry vectors. Vector constructed by insertion of Gateway vector conversion cassette reading frame A into pMAL-c2X. Expression cassette (ptac promoter, male gene, Gateway cassette and polylinker) subsequently cloned into pMTL. |
| 138 | DNA coding for LH$_N$/A-ligand (*Erythrina cristagalli* lectin) fusion in which the LC-H$_N$ junction incorporates a specific enterokinase protease activation site and the ligand is spaced from the H$_N$ domain by a peptide sequence derived from an Rnase A loop |
| 139 | LH$_N$/A-ligand (*Erythrina cristagalli* lectin) fusion produced by expression of SEQ ID 138, in which the LC-H$_N$ junction incorporates a specific enterokinase protease activation site and the ligand is spaced from the H$_N$ domain by a peptide sequence derived from an Rnase A loop |
| 140 | DNA coding for tetanus toxin |
| 141 | Tetanus toxin produced by expression of SEQ ID 140, said polypeptide incorporating the LC, H$_N$ and H$_C$ domains |
| 142 | DNA coding for LH$_N$ of tetanus toxin, in which the 3' end of the clone encodes the sequence . . . Glu-Glu-Asp-Ile-Asp-Val-STOP, terminating at residue Val879 |
| 143 | LH$_N$ of tetanus toxin produced by expression of SEQ ID 142, said polypeptide terminating with the sequence . . . Glu-Glu-Asp-Ile-Asp-Val-STOP, terminating at residue Val879. |
| 144 | DNA coding for LH$_N$ of tetanus toxin, in which the 3' end of the clone encodes the sequence . . . Glu-Glu-Asp-Ile-Asp- |

| SEQ ID NO: | Sequence |
|---|---|
| | Val-STOP as in SEQ ID 142. The clone also incorporates a specific enterokinase protease activation site at the junction of the LC and $H_N$ domain. |
| 145 | $LH_N$ of tetanus toxin produced by expression of SEQ ID 144, said polypeptide terminating with the sequence . . . Glu-Glu-Asp-Ile-Asp-Val-STOP as in SEQ ID 143. The protein also incorporates a specific enterokinase protease activation site at the junction of the LC and $H_N$ domain. |
| 146 | DNA coding for $LH_N$ of tetanus toxin, in which the 3' end of the clone encodes the sequence . . . Glu-Glu-Asp-Ile-Asp-Val-Ile-Leu-Lys-Lys-Ser-Thr-Ile-Leu-STOP, terminating at residue Leu887 |
| 147 | $LH_N$ of tetanus toxin produced by expression of SEQ ID 146, said polypeptide terminating with the sequence . . . Glu-Glu-Asp-Ile-Asp-Val-Ile-Leu-Lys-Lys-Ser-Thr-Ile-Leu-STOP, terminating at residue Leu887 |
| 148 | DNA encoding $_2LH_{423}/A(Q_2E)$ |
| 149 | $_2LH_{423}/A(Q_2E)$, which is a single polypeptide comprising a BoNT/A L-chain and the N-terminal 423 amino acid residues of a BoNT/A H-chain. The polypeptide has been generated by cleavage from a GST purification tag and has a 2 amino acid extension (GS) on the N-terminus of the L-chain resulting from the proteolytic cleavage of the L-chain from the purification tag. The polypeptide has a variant amino acid residue E at position 2 compared with Q in a native serotype A L-chain. |
| 150 | DNA encoding $_2LH_{423}/A(Q_2E)$, wherein the DNA has an E. coli codon bias. |
| 151 | $_2LH_{423}/A(Q_2E)$, which is equivalent to SED ID NO 149. |
| 152 | DNA encoding $LH_{423}/A(Q_2E)$, wherein the DNA has an E. coli codon bias. |
| 153 | $LH_{423}/A(Q_2E)$, which is equivalent to SEQ ID NO 151 but without any N-terminal extension to the L-chain. |
| 154 | DNA encoding $LH_{423}/A(Q_2E)$. |
| 155 | $LH_{423}/A(Q_2E)$, which is equivalent to SEQ ID NO 149 but without any N-terminal extension to the L-chain. |
| 156 | DNA encoding $_2L_{FXa}/_3H_{423}/A(Q_2E)$. |
| 157 | $_2L_{FXa}/_3H_{423}/A(Q_2E)$, which is equivalent to SEQ ID NO 151 and wherein a Factor Xa cleavage site has been introduced between the L-chain and H-chain components of the polypeptide. |
| 158 | DNA encoding $LH_{423}/A(Q_2E)$-6His. |
| 159 | $LH_{423}/A(Q_2E)$-6His, which is a native $LH_N$ molecule and includes a C-terminal poly-His purification tag. |
| 160 | DNA encoding $_2L_{FXa}/_3H_{423}/A(Q_2E)_{FXa}$-6His. |
| 161 | $_2L_{FXa}/_3H_{423}/A(Q_2E)_{FXa}$-6His, which is equivalent to SEQ ID NO 157 and includes a Factor Xa cleavage site to facilitate removal of the poly-His purification tag. |
| 162 | DNA encoding $_2LH_{423}/A(Q_2E, H_{227}Y)$. |
| 163 | $_2LH_{423}/A(Q_2E, H_{227}Y)$, which is equivalent to SEQ ID NO 149 and wherein the polypeptide has a variant amino acid residue Y at position 227 compared with H in a native serotype A L-chain. |
| 164 | DNA encoding $_2LH_{423}/A(Q_2E, H_{227}Y)$, wherein the DNA has an E. coli codon bias. |
| 165 | $_2LH_{423}/A(Q_2E, H_{227}Y)$, which is equivalent to SEQ ID NO 163. |
| 166 | DNA encoding $_2LH_{423}/A(Q_2E, E_{224}Q)$, wherein the DNA has an E. coli codon bias. |
| 167 | $_2LH_{423}/A(Q_2E, E_{224}Q)$, which is equivalent to SEQ ID NO 151 and wherein the polypeptide has a variant amino acid residue Q at position 224 compared with E in a native serotype A L-chain. |
| 168 | DNA encoding $_2LH_{423}/A(Q_2E, E_{224}Q, H_{227}Y)$, wherein the DNA has an E. coli codon bias. |
| 169 | $_2LH_{423}/A(Q_2E, E_{224}Q, H_{227}Y)$, which is equivalent to SEQ ID NO 167 and wherein the polypeptide has a variant amino acid residue Y at position 227 compared with H in a native serotype A L-chain. |
| 170 | DNA encoding $L_{FXa}/H_{417}/B$. |
| 171 | $L_{FXa}/H_{417}/B$, which is a single polypeptide comprising a BoNT/B L-chain and the N-terminal 417 amino acid residues of a BoNT/B H-chain, wherein a Factor Xa cleavage site exists between the L-chain and H-chain. |
| 172 | DNA encoding $L_{FXa}/H_{417}/B$. |
| 173 | $L_{FXa}/H_{417}/B$, which is a single polypeptide comprising a BoNT/B L-chain and the N-terminal 417 amino acid residues of a BoNT/B H-chain, wherein a Factor Xa cleavage site exists between the L-chain and H-chain. |
| 174 | DNA encoding $L_{FXa}/H_{417}/B$. |
| 175 | $L_{FXa}/H_{417}/B$, which is equivalent to SEQ ID NO 173, wherein a modified linker sequence exists between the L-chain and H-chain vis-a-vis SEQ ID NO 173. |

EXAMPLE 1

Figure 1:
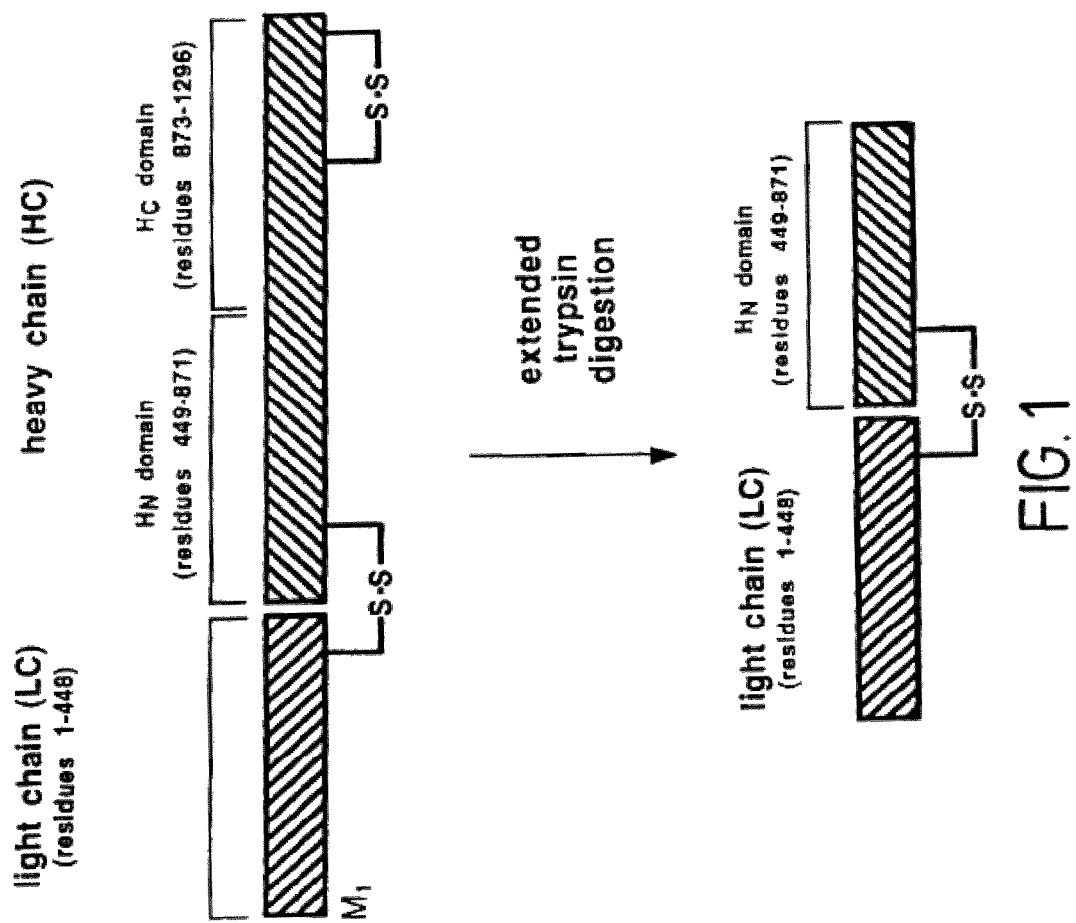
FIG. 1 shows a schematic representation of the domain structure of botulinum neurotoxin type A (BoNT/A)
Figure 2:
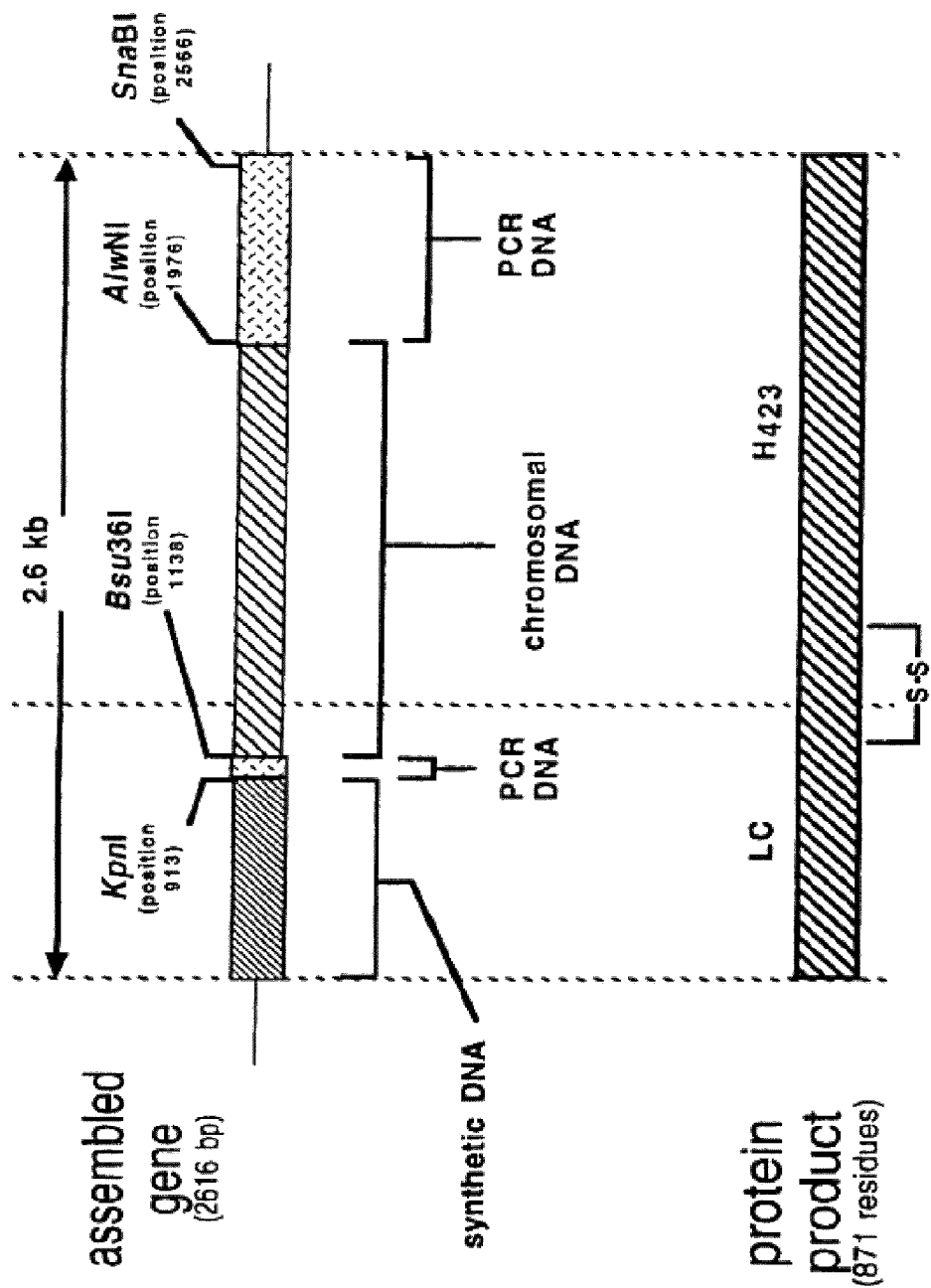
FIG. 2 shows a schematic representation of assembly of the gene for an embodiment of the invention designated LH$_{423}$/A.

A 2616 base pair, double stranded gene sequence (SEQ ID NO: 1) has been assembled from a combination of synthetic, chromosomal and polymerase-chain-reaction generated DNA (FIG. 2). The gene codes for a polypeptide of 871 amino acid residues corresponding to the entire light-chain (LC, 448 amino acids) and 423 residues of the amino terminus of the heavy-chain ($H_C$) of botulinum neurotoxin type A. This recombinant product is designated the $LH_{423}/A$ fragment (SEQ ID NO: 2).

Construction of the Recombinant Product

The first 918 base pairs of the recombinant gene were synthesised by concatenation of short oligonucleotides to generate a coding sequence with an E. coli codon bias. Both DNA strands in this region were completely synthesised as short overlapping oligonucleotides which were phosphorylated, annealed and ligated to generate the full synthetic region ending with a unique KpnI restriction site. The remainder of the $LH_{423}/A$ coding sequence was PCR amplified from total chromosomal DNA from Clostridium botulinum and annealed to the synthetic portion of the gene.

The internal PCR amplified product sequences were then deleted and replaced with the native, fully sequenced, regions from clones of C. botulinum chromosomal origin to generate the final gene construct. The final composition is synthetic DNA (bases 1-913), polymerase amplified DNA (bases 914-1138 and 1976-2616) and the remainder is of C. botulinum chromosomal origin (bases 1139-1975). The assembled gene was then fully sequenced and cloned into a variety of E. coli plasmid vectors for expression analysis.

Expression of the Recombinant Gene and Recovery of Protein Product

The DNA is expressed in E. coli as a single nucleic acid transcript producing a soluble single chain polypeptide of 99,951 Daltons predicted molecular weight. The gene is currently expressed in E. coli as a fusion to the commercially available coding sequence of glutathione S-transferase (GST) of Schistosoma japonicum but any of an extensive range of recombinant gene expression vectors such as pEZZ18, pTrc99, pFLAG or the pMAL series may be equally effective as might expression in other prokaryotic or eukaryotic hosts such as the Gram positive bacilli, the yeast P. pastoris or in insect or mammalian cells under appropriate conditions.

Currently, E. coli harbouring the expression construct is grown in Luria-Bertani broth (L-broth pH 7.0, containing 10 g/l bacto-tryptone, 5 g/l bacto-yeast extract and 10 g/l sodium chloride) at 37E C until the cell density (biomass) has an optical absorbance of 0.4-0.6 at 600 nm and the cells are in mid-logarithmic growth phase. Expression of the gene is then induced by addition of isopropylthio-β-D-galactosidase (IPTG) to a final concentration of 0.5 mM. Recombinant gene expression is allowed to proceed for 90 min at a reduced temperature of 25EC. The cells are then harvested by centrifugation, are resuspended in a buffer solution containing 10 mM Na$_2$HPO$_4$, 0.5 M NaCl, 10 mM EGTA, 0.25% Tween, pH 7.0 and then frozen at −20EC. For extraction of the recombinant protein the cells are disrupted by sonication. The cell extract is then cleared of debris by centrifugation and the cleared supernatant fluid containing soluble recombinant fusion protein (GST-LH$_{423}$/A) is stored at −20EC pending purification. A proportion of recombinant material is not released by the sonication procedure and this probably reflects insolubility or inclusion body formation. Currently we do not extract this material for analysis but if desired this could be readily achieved using methods known to those skilled in the art.

The recombinant GST-LH$_{423}$/A is purified by adsorption onto a commercially prepared affinity matrix of glutathione Sepharose and subsequent elution with reduced glutathione. The GST affinity purification marker is then removed by proteolytic cleavage and reabsorption to glutathione Sepharose; recombinant LH$_{423}$/A is recovered in the non-adsorbed material.

Construct Variants

A variant of the molecule, LH$_{423}$/A (Q$_2$E,N$_{26}$K,A$_{27}$Y) (SEQ ID NO: 26) has been produced in which three amino acid residues have been modified within the light chain of LH$_{423}$/A producing a polypeptide containing a light chain sequence different to that of the published amino acid sequence of the light chain of BoNT/A.

Two further variants of the gene sequence that have been expressed and the corresponding products purified are $_{23}$LH$_{423}$/A (Q$_2$E,N$_{26}$K,A$_{27}$Y) (SEQ ID NO: 4) which has a 23 amino acid N-terminal extension as compared to the predicted native L-chain of BoNT/A and $_2$LH$_{423}$/A (Q$_2$E,N$_{26}$K, A$_{27}$Y) (SEQ ID NO: 6) which has a 2 amino acid N-terminal extension (FIG. 4).

In yet another variant a gene has been produced which contains a Eco 47 III restriction site between nucleotides 1344 and 1345 of the gene sequence given in (SEQ ID NO: 1). This modification provides a restriction site at the position in the gene representing the interface of the heavy and light chains in native neurotoxin, and provides the capability to make insertions at this point using standard restriction enzyme methodologies known to those skilled in the art. It will also be obvious to those skilled in the art that any one of a number of restriction sites could be so employed, and that the Eco 47 III insertion simply exemplifies this approach. Similarly, it would be obvious for one skilled in the art that insertion of a restriction site in the manner described could be performed on any gene of the invention. The gene described, when expressed, codes for a polypeptide, L$_{/4}$H$_{423}$/A (SEQ ID NO: 10), which contains an additional four amino acids between amino acids 448 and 449 of LH$_{423}$/A at a position equivalent to the amino terminus of the heavy chain of native BoNT/A.

A variant of the gene has been expressed, L$_{FXa/3}$H$_{423}$/A (SEQ ID NO: 12), in which a specific proteolytic cleavage site was incorporated at the carboxy-terminal end of the light chain domain, specifically after residue 448 of L/$_4$H$_{423}$/A. The cleavage site incorporated was for Factor Xa protease and was coded for by modification of SEQ ID NO: 1. It will be apparent to one skilled in the art that a cleavage site for another specified protease could be similarly incorporated, and that any gene sequence coding for the required cleavage site could be employed. Modification of the gene sequence in this manner to code for a defined protease site could be performed on any gene of the invention.

Variants of L$_{FXa/3}$ H$_{423}$/A have been constructed in which a third domain is present at the carboxy-terminal end of the polypeptide which incorporates a specific binding activity into the polypeptide.

Specific examples described are:

(1) L$_{FXa/3}$H$_{423}$/A-IGF-1 (SEQ ID NO: 14), in which the carboxy-terminal domain has a sequence equivalent to that of insulin-like growth factor-1 (IGF-1) and is able to bind to the insulin-like growth factor receptor with high affinity;

(2) L$_{FXa/3}$H$_{423}$/A-CtxA14 (SEQ ID NO: 16), in which the carboxy-terminal domain has a sequence equivalent to that of the 14 amino acids from the carboxy-terminus of the A-subunit of cholera toxin (CtxA) and is thereby able to interact with the cholera toxin B-subunit pentamer; and (3) L$_{FXa/3}$H$_{423}$/A-ZZ (SEQ ID NO: 18), in which the carboxy-terminal domain is a tandem repeating synthetic IgG binding domain. This variant also exemplifies another modification applicable to the current invention, namely the inclusion in the gene of a sequence coding for a protease cleavage site located between the end of the clostridial heavy chain sequence and the sequence coding for the binding ligand. Specifically in this example a sequence is inserted at nucleotides 2650 to 2666 coding for a genenase cleavage site. Expression of this gene produces a polypeptide which has the desired protease sensitivity at the interface between the domain providing H$_N$ function and the binding domain. Such a modification enables selective removal of the C-terminal binding domain by treatment of the polypeptide with the relevant protease.

It will be apparent that any one of a number of such binding domains could be incorporated into the polypeptide sequences of this invention and that the above examples are merely to exemplify the concept. Similarly, such binding domains can be incorporated into any of the polypeptide sequences that are the basis of this invention. Further, it should be noted that such binding domains could be incorporated at any appropriate location within the polypeptide molecules of the invention.

Further embodiments of the invention are thus illustrated by a DNA of the invention further comprising a desired restriction endonuclease site at a desired location and by a polypeptide of the invention further comprising a desired protease cleavage site at a desired location.

The restriction endonuclease site may be introduced so as to facilitate further manipulation of the DNA in manufacture of an expression vector for expressing a polypeptide of the invention; it may be introduced as a consequence of a previous step in manufacture of the DNA; it may be introduced by way of modification by insertion, substitution or deletion of a known sequence. The consequence of modification of the DNA may be that the amino acid sequence is unchanged, or may be that the amino acid sequence is changed, for example resulting in introduction of a desired protease cleavage site, either way the polypeptide retains its first and second domains having the properties required by the invention.

FIG. 10 is a diagrammatic representation of an expression product exemplifying features described in this example. Specifically, it illustrates a single polypeptide incorporating a domain equivalent to the light chain of botulinum neurotoxin type A and a domain equivalent to the H$_N$ domain of the heavy chain of botulinum neurotoxin type A with a N-terminal extension providing an affinity purification domain, namely GST, and a C-terminal extension providing a ligand binding domain, namely an IgG binding domain. The domains of the polypeptide are spatially separated by specific protease cleavage sites enabling selective enzymatic separation of domains as exemplified in the Figure. This concept is more specifically depicted in FIG. 11 where the various protease sensitivities are defined for the purpose of example.

Assay of Product Activity

Figure 3:
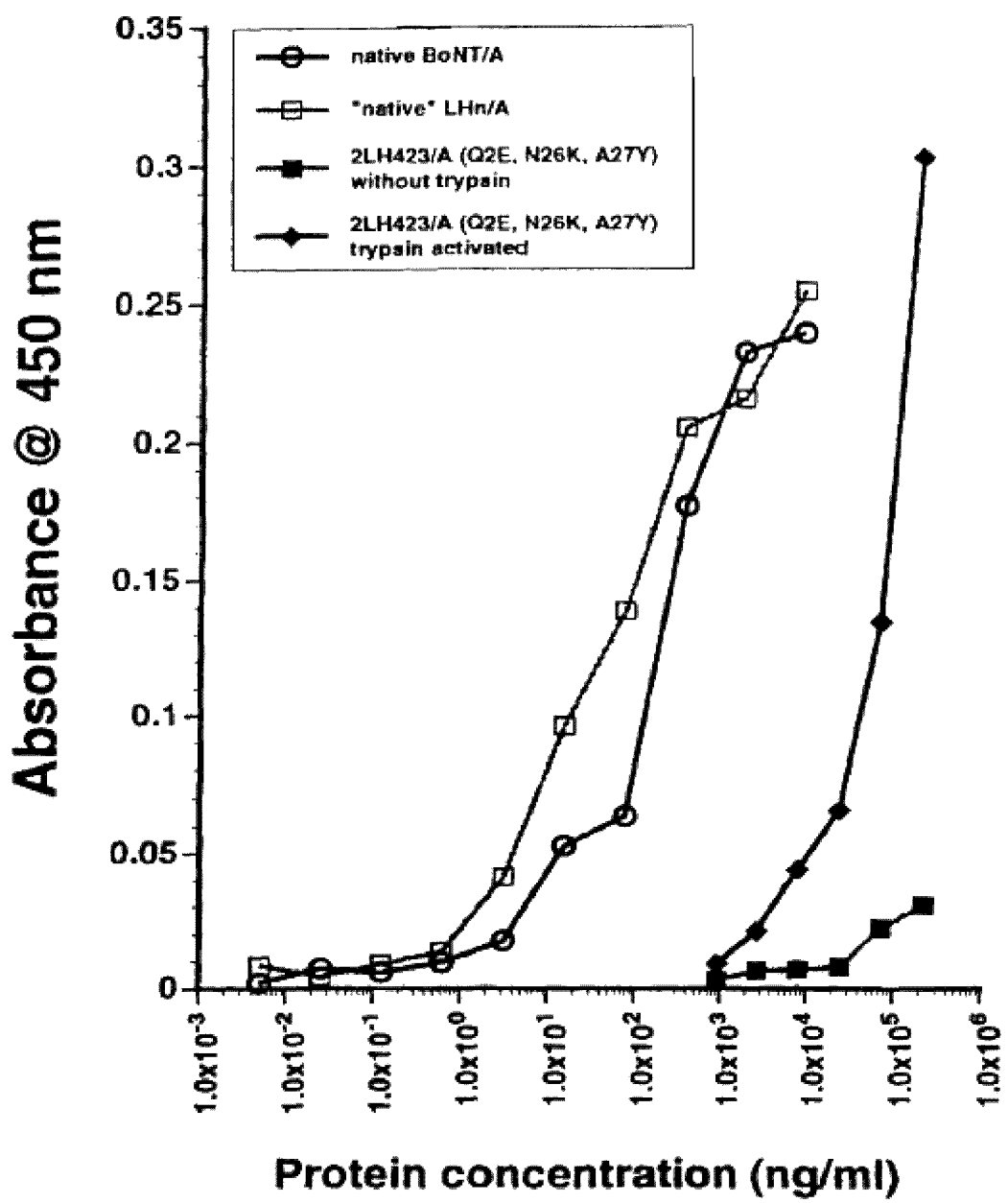
FIG. 3 is a graph comparing activity of native toxin, trypsin generated "native" LH$_N$/A and an embodiment of the invention designated $_2$LH$_{423}$/A (Q$_2$E,N$_{26}$K,A$_{27}$Y) in an in vitro peptide cleavage assay.

The LC of botulinum neurotoxin type A exerts a zinc-dependent endopeptidase activity on the synaptic vesicle associated protein SNAP-25 which it cleaves in a specific manner at a single peptide bond. The $_2LH_{423}$/A ($Q_2E,N_{26}K,A_{27}Y$) (SEQ ID NO: 6) cleaves a synthetic SNAP-25 substrate in vitro under the same conditions as the native toxin (FIG. 3). Thus, the modification of the polypeptide sequence of $_2LH_{423}$/A ($Q_2E,N_{26}K,A_{27}Y$) relative to the native sequence and within the minimal functional LC domains does not prevent the functional activity of the LC domains.

This activity is dependent on proteolytic modification of the recombinant GST-$_2LH_{423}$/A ($Q_2E,N_{26}K,A_{27}Y$) to convert the single chain polypeptide product to a disulphide linked dichain species. This is currently done using the proteolytic enzyme trypsin. The recombinant product (100-600 Φg/ml) is incubated at 37EC for 10-50 minutes with trypsin (10 Φg/ml) in a solution containing 140 mM NaCl, 2.7 mM KCl, 10 mM $Na_2HPO_4$, 1.8 mM $KH_2PO_4$, pH 7.3. The reaction is terminated by addition of a 100-fold molar excess of trypsin inhibitor. The activation by trypsin generates a disulphide linked dichain species as determined by polyacrylamide gel electrophoresis and immunoblotting analysis using polyclonal anti-botulinum neurotoxin type A antiserum.

$_2LH_{423}$/A is more stable in the presence of trypsin and more active in the in vitro peptide cleavage assay than is $_{23}LH_{423}$/A. Both variants, however, are fully functional in the in vitro peptide cleavage assay. This demonstrates that the recombinant molecule will tolerate N-terminal amino acid extensions and this may be expanded to other chemical or organic moieties as would be obvious to those skilled in the art.

EXAMPLE 2

As a further exemplification of this invention a number of gene sequences have been assembled coding for polypeptides corresponding to the entire light-chain and varying numbers of residues from the amino terminal end of the heavy chain of botulinum neurotoxin type B. In this exemplification of the disclosure the gene sequences assembled were obtained from a combination of chromosomal and polymerase-chain-reaction generated DNA, and therefore have the nucleotide sequence of the equivalent regions of the natural genes, thus exemplifying the principle that the substance of this disclosure can be based upon natural as well as a synthetic gene sequences.

The gene sequences relating to this example were all assembled and expressed using methodologies as detailed in Sambrook J, Fritsch E F & Maniatis T (1989) Molecular Cloning: A Laboratory Manual (2nd Edition), Ford N, Nolan C, Ferguson M & Ockler M (eds), Cold Spring Harbor Laboratory Press, New York, and known to those skilled in the art.

A gene has been assembled coding for a polypeptide of 1171 amino acids corresponding to the entire light-chain (443 amino acids) and 728 residues from the amino terminus of the heavy chain of neurotoxin type B. Expression of this gene produces a polypeptide, $LH_{728}$/B (SEQ ID NO: 20), which lacks the specific neuronal binding activity of full length BoNT/B.

A gene has also been assembled coding for a variant polypeptide, $LH_{417}$/B (SEQ ID NO: 22), which possesses an amino acid sequence at its carboxy terminus equivalent by amino acid homology to that at the carboxy-terminus of the heavy chain fragment in native $LH_N$/A.

A gene has also been assembled coding for a variant polypeptide, $LH_{107}$/B (SEQ ID NO: 24), which expresses at its carboxy-terminus a short sequence from the amino terminus of the heavy chain of BoNT/B sufficient to maintain solubility of the expressed polypeptide.

Construct Variants

A variant of the coding sequence for the first 274 bases of the gene shown in SEQ ID NO: 21 has been produced which whilst being a non-native nucleotide sequence still codes for the native polypeptide.

Two double stranded, a 268 base pair and a 951 base pair, gene sequences have been created using an overlapping primer PCR strategy. The nucleotide bias of these sequences was designed to have an E. coli codon usage bias.

For the first sequence, six oligonucleotides representing the first (5') 268 nucleotides of the native sequence for botulinum toxin type B were synthesised. For the second sequence 23 oligonucleotides representing internal sequence nucleotides 691-1641 of the native sequence for botulinum toxin type B were synthesised. The oligonucleotides ranged from 57-73 nucleotides in length. Overlapping regions, 17-20 nucleotides, were designed to give melting temperatures in the range 52-56EC. In addition, terminal restriction endonuclease sites of the synthetic products were constructed to facilitate insertion of these products into the exact corresponding region of the native sequence. The 268 bp 5' synthetic sequence has been incorporated into the gene shown in SEQ ID NO: 21 in place of the original first 268 bases (and is shown in SEQ ID NO: 27).

Similarly the sequence could be inserted into other genes of the examples.

Another variant sequence equivalent to nucleotides 691 to 1641 of SEQ ID NO: 21, and employing non-native codon usage whilst coding for a native polypeptide sequence, has been constructed using the internal synthetic sequence. This sequence (SEQ ID NO: 28) can be incorporated, alone or in combination with other variant sequences, in place of the equivalent coding sequence in any of the genes of the example.

EXAMPLE 3

An exemplification of the utility of this invention is as a non-toxic and effective immunogen. The non-toxic nature of the recombinant, single chain material was demonstrated by intraperitoneal administration in mice of GST-$_2LH_{423}$/A. The polypeptide was prepared and purified as described above. The amount of immunoreactive material in the final preparation was determined by enzyme linked immunosorbent assay (ELISA) using a monoclonal antibody (BA11) reactive against a conformation dependent epitope on the native $LH_N$/A. The recombinant material was serially diluted in phosphate buffered saline (PBS; NaCl 8 g/l, KCl 0.2 g/l, $Na_2HPO_4$ 1.15 g/l, $KH_2PO_4$ 0.2 g/l, pH 7.4) and 0.5 ml volumes injected into 3 groups of 4 mice such that each group of mice received 10, 5 and 1 micrograms of material respectively. Mice were observed for 4 days and no deaths were seen.

For immunisation, 20 Φg of GST-$_2LH_{423}$/A in a 1.0 ml volume of water-in-oil emulsion (1:1 vol:vol) using Freund's complete (primary injections only) or Freund's incomplete adjuvant was administered into guinea pigs via two subcutaneous dorsal injections. Three injections at 10 day intervals were given (day 1, day 10 and day 20) and antiserum collected on day 30. The antisera were shown by ELISA to be immunoreactive against native botulinum neurotoxin type A and to its derivative $LH_N$/A. Antisera which were botulinum neurotoxin reactive at a dilution of 1:2000 were used for evaluation of neutralising efficacy in mice. For neutralisation assays 0.1 ml of antiserum was diluted into 2.5 ml of gelatine phosphate buffer (GPB; Na$_2$HPO$_4$ anhydrous 10 g/l, gelatin (Difco) 2 g/l, pH 6.5-6.6) containing a dilution range from 0.5 Φg (5×10$^{-6}$ g) to 5 picograms (5×10$^{-12}$ g). Aliquots of 0.5 ml were injected into mice intraperitoneally and deaths recorded over a 4 day period. The results are shown in Table 3 and Table 4. It can clearly be seen that 0.5 ml of 1:40 diluted anti-GST-$_2$LH$_{423}$/A antiserum can protect mice against intraperitoneal challenge with botulinum neurotoxin in the range 5 pg-50 ng (1-10,000 mouse LD50; 1 mouse LD50=5 pg).

TABLE 3

Neutralisation of botulinum neurotoxin in mice by guinea pig anti-GST-$_2$LH$_{423}$/A antiserum.

| Survivors On Day | Botulinum Toxin/mouse | | | | | | Control (no toxin) |
|---|---|---|---|---|---|---|---|
| | 0.5 µg | 0.005 µg | 0.0005 µg | 0.5 ng | 0.005 ng | 5 pg | |
| 1 | 0 | 4 | 4 | 4 | 4 | 4 | 4 |
| 2 | — | 4 | 4 | 4 | 4 | 4 | 4 |
| 3 | — | 4 | 4 | 4 | 4 | 4 | 4 |
| 4 | — | 4 | 4 | 4 | 4 | 4 | 4 |

TABLE 4

Neutralisation of botulinum neurotoxin in mice by non-immune guinea pig antiserum.

| Survivors On Day | Botulinum Toxin/mouse | | | | | | Control (no toxin) |
|---|---|---|---|---|---|---|---|
| | 0.5 µg | 0.005 µg | 0.0005 µg | 0.5 ng | 0.005 ng | 5 pg | |
| 1 | 0 | 0 | 0 | 0 | 0 | 2 | 4 |
| 2 | — | — | — | — | — | 0 | 4 |
| 3 | — | — | — | — | — | — | 4 |
| 4 | — | — | — | — | — | — | 4 |

EXAMPLE 4

Expression of Recombinant LH$_{107}$/B in *E. Coli*

As an exemplification of the expression of a nucleic acid coding for a LH$_N$ of a clostridial neurotoxin of a serotype other than botulinum neurotoxin type A, the nucleic acid sequence (SEQ ID NO: 23) coding for the polypeptide LH$_{107}$/B (SEQ ID NO: 24) was inserted into the commercially available plasmid pET28a (Novogen, Madison, Wis., USA). The nucleic acid was expressed in *E. coli* BL21 (DE3) (New England BioLabs, Beverley, Mass., USA) as a fusion protein with a N-terminal T7 fusion peptide, under IPTG induction at 1 mM for 90 minutes at 37EC. Cultures were harvested and recombinant protein extracted as described previously for LH$_{423}$/A.

Recombinant protein was recovered and purified from bacterial paste lysates by immunoaffinity adsorption to an immobilised anti-T7 peptide monoclonal antibody using a T7 tag purification kit (New England bioLabs, Beverley, Mass., USA). Purified recombinant protein was analysed by gradient (4-20%) denaturing SDS-polyacrylamide gel electrophoresis (Novex, San Diego, Calif., USA) and western blotting using polyclonal anti-botulinum neurotoxin type antiserum or anti-T7 antiserum. Western blotting reagents were from Novex, immunostained proteins were visualised using the Enhanced Chemi-Luminescence system (ECL) from Amersham. The expression of an anti-T7 antibody and anti-botulinum neurotoxin type B antiserum reactive recombinant product is demonstrated in FIG. 13.

The recombinant product was soluble and retained that part of the light chain responsible for endopeptidase activity.

The invention thus provides recombinant polypeptides useful inter alia as immunogens, enzyme standards and components for synthesis of molecules as described in WO-A-94/21300.

EXAMPLE 5

Expression and Purification of LH$_N$C

The LH$_N$C DNA fragment from the native clostridial neurotoxin gene was subcloned as a SalI-PstI fragment into the expression vector pMal-c2x (New England Biolabs). The gene fragment and the protein product that would be produced after proteolytic processing from the MBP-fusion protein are defined in SEQ ID 129/130. Other commercially available expression systems such as pET vector (Novagen) pGEX vectors (Pharmacia) or pQE vectors (Qiagen) would also be suitable for expression of the gene fragments.

The expression clone was transferred into the host strain AD494 (Novagen) containing a pACYC plasmid carrying the tRNA genes for the codons ATA, AGA, and CTA (commercially available, for example, as Rosetta strains from Novagen). As these codons are rarely used in *E. coli*, but are frequent in the clostridial genes encoding neurotoxins, the inclusion of these tRNA genes significantly increases expression levels. Those familiar with the art would recognise that this effect is not limited to LH$_N$/C but is broadly applicable to all native clostridial LH$_N$ fragments. Similar effects were observed in other host strains including HMS174 (Novagen) and TB1 (NEB), and a wide range of other hosts would be suitable for expression of these fragments.

Expression cultures of AD494 (pACYC tRNAs) pMalc2x LH$_N$/C were grown in Terrific Broth containing 35 µg/ml chloramphenicol, 100 µg/ml ampicillin, 1 µM ZnCl$_2$ and 0.5% (w/v) glucose with an overnight culture diluted 1:100 into fresh media and grown for approximately 3 hours at 37° C. to an OD$_{600}$ of 0.6-1. The cultures were induced with 1 mM IPTG and grown at 30° C. for 3-4 hours. Other expression systems used similar conditions except that the antibiotic was changed to kanamycin. Cells were lysed by either sonication in column buffer (20 mM Hepes 125 mM NaCl 1 µM ZnCl$_2$ pH 7.2) or suitable detergent treatment (e.g. Bugbuster reagent; Novagen) and cell debris pelleted by centrifugation. Supernatant proteins were loaded onto an amylose resin column equilibrated in column buffer and proteins eluted with a single step elution using column buffer with 10 mM maltose.

The MBP-LH$_N$/C construct used in this example has a factor Xa site situated between the MBP and LH$_N$ domains and also has a factor Xa site between the L and H$_N$ domains to allow the formation of the di-chain LH$_N$ form. To remove the fusion tag and in this case to activate the LH$_N$ fragment, the eluted protein from the amylose column is treated with factor Xa at a concentration of 1 unit protease activity per 50 µg purified fusion protein (as outlined by the manufacturer e.g. NEB) for approximately 20 hours at 25° C. The protein is then diluted 1:5 with 20 mM Hepes pH 7.2 and loaded onto a Q-sepharose fast flow column, the column washed and proteins eluted using a linear gradient of 25-500 mM NaCl in the 20 mM Hepes buffer. The free LH$_N$ fragment is eluted at approximately 50 mM NaCl with uncleaved fusion protein and free MBP eluted at higher concentrations of NaCl.

Those familiar with the art will recognise that for alternative expression vectors such as pMal-c2g, where the site for removal of the MBP tag is genenase, two subsequent protease cleavage reactions would be required for removal of the fusion partner (genenase cleavage) and subsequent activation of the $LH_N$ (factor Xa digestion). These cleavage reactions could be carried out simultaneously or with an intermediate ion exchange purification to remove contaminating proteins. An example of this model of purification/activation is identified below. These considerations are equally valid for native or synthetic activation sites as detailed in the sequence information and for $LH_N$ fragments of all the serotypes.

EXAMPLE 6

Expression and Purification of $LH_N/F$

The $LH_N$ fragment from the native BoNT/F gene was modified by PCR to incorporate BamHI and HindIII, or other suitable sites, at the 5' and 3' ends respectively. The gene fragment was cloned into pET 28 to maintain the reading frames with the N-terminal $His_6$ purification tag. The expression clone was transferred to a host strain carrying the pACYC tRNA plasmid as outlined in example 5 and the DE3 lysogen carrying the T7 polymerase gene. Suitable host strains would include JM109, AD494, HMS174, TB1 TG1 or BL21 carrying the appropriate genetic elements. For example HMS174 (DE3) pACYC tRNA pET28a $LH_N/F$ was used for expression and purification.

Expression cultures of HMS174 (DE3) pACYC tRNA pET28a $LH_N/F$ were grown in Terrific Broth containing 35 µg/ml chloramphenicol, 35 µg/ml kanamycin, 1 µM $ZnCl_2$ and 0.5% (w/v) glucose to an $OD_{600}$ of 2.0 at 30° C. and cultures were induced with 500 µM IPTG and grown at 25° C. for 2 hours prior to harvest by centrifugation. The cells were lysed in 20 mM Hepes 500 mM NaCl pH 7.4 by sonication or detergent lysis and the soluble protein fraction loaded onto a metal chelate column (e.g. IMAC HiTrap column Amersham-Pharmacia) loaded with $CuSO_4$. Protein was eluted using a linear gradient of imidazole with $His_6$ $LH_N/F$ eluting at between 50 and 250 mM imidazole.

The $His_6$ tag was removed by treatment with thrombin essentially as described in Example 5. The released $LH_N$ fragment was purified using ion exchange on a Q-sepharose column as described in Example 5.

EXAMPLE 7

Expression and Purification of $LH_N$TeNT

A native $LH_N$TeNT gene fragment was modified to replace the native linker region with an enterokinase cleavable linker as shown in SEQ ID 144/145 and to incorporate cloning sites at the 5' (BamHI) and 3' ends (HindIII). This fragment was subcloned into pMAL c2x and expressed in HMS174 (pACYC tRNA) as described in Example 5. Initial purification on an amylose resin column, cleavage with factor Xa to remove the fusion tag and the ion exchange purification was also as described in Example 5 except that the positions of the elution peaks were reversed with the free MBP peak eluting before the peak for free $LH_N$.

EXAMPLE 8

Expression of $LH_N/C$ from a Gateway Adapted Expression Vector

The $LH_N C$ fragment was cloned into a Gateway entry vector as a SalI-PstI. Two version were made with a stop codon within the 3' PstI site to terminate the protein at this position ($LH_N C$ STOP; SEQ ID 123/124), or with no stop codon to allow the expression of the fragment with C-terminal fusion partners ($LH_N C$ NS; SEQ ID 131/132). The entry vector was recombined with the destination vector to allow expression of the fragment with an N-terminal MBP tag. Recombination was according to standard protocols (Invitrogen Gateway expression manual).

Expression of the fusion protein from the strain AD494 (pACYC tRNA) pMTL-malE-GW $LH_N C$ STOP, and its purification and was as described in Example 5. The addition of the additional N-terminal sequence made no significant change to the overall expression and purification. The final product following factor Xa cleavage was a disulfide bonded di-chain fragment as described above.

For expression of the fragment with additional C-terminal domains the $LH_N C$ NS entry vector was recombined with a destination vector carrying additional sequences following the attachment site and in the appropriate frame. The sequence of the DNA encoding the $LH_N/C$ fragment flanked by att sites that has the properties necessary to facilitate recombination to create a full fusion is described in SEQ ID 133. For example, the destination vector pMTL-malE-GW-att-IGF was produced by subcloning the coding sequence for human IGF as an XbaI-HindIII fragment into the appropriate sites. Recombination of the $LH_N/C$ NS fragment into this vector yielded pMTL-malE-GW-$LH_N C$-att-IGF.

This clone was expressed and purified as described above. Additional purification methods utilising the binding properties of the C-terminal IGF domain could also be used if desired.

Those familiar with the art will recognise that a similar approach could be used for other $LH_N$ fragments from either BoNT/C or other serotypes. Similarly other C-terminal purification tags or ligands could be incorporated into destination vectors in the same way as for IGF above.

EXAMPLE 9

Expression of $LH_N$TeNT from a Gateway Adapted Expression Vector

The $LH_N$TeNT BamHI-HindIII fragment described in Example 7 was subcloned into an entry vector to maintain the appropriate reading frames. The entry vector was designed to incorporate a factor Xa site immediately adjacent to the BamHI site such that cleavage resulted in a protein starting with the GlySer residues encoded by the BamHI site. The entry vector was recombined with a commercially available destination vector carrying an N-terminal 6-His tag (e.g. pDEST17; Invitrogen). The resulting clone pDEST17 $LH_N$TeNT was expressed in the host strain HMS174 (pACYC tRNA). As described in Example 6. Purification of the fusion protein is also as described in Example 5 with the N-terminal His tag removed by factor Xa treatment, followed by subsequent removal of factor Xa on a Q-sepharose column.

EXAMPLE 10

Directed Coupling of an $LH_N/B$ Fragment and a Ligand via a fos/jun or Glu/Arg Molecular Clamp $LH_N/C$ clones of the type described in SEQ ID 115/116, 117/118, 119/120 & 121/122 were expressed and purified as previously indicated in Example 5. Purified, activated $LH_N/C$ protein was then mixed with an equimolar amount of ligand tagged with the complementary clamp partner (jun-tagged ligand for SEQ ID 117/118 and 121/122; poly-arginine-tagged ligand for SEQ ID 115/116 and 119/120). Proteins were gently mixed to facilitate associated, then purified to isolate associated ligand-endopeptidase fragment.

EXAMPLE 11

Directed Coupling of an $LH_N$TeNT Fragment and a Ligand via an Acid/Base Molecular Clamp $LH_N$TeNT clones of the type described in SEQ ID 142/143, 144/145 & 146/147 were modified to incorporate one component of the acid/base leucine zipper clamping system. Following expression and purification of the tagged proteins as previously indicated in Example 5, the association with tagged ligand was performed essentially as described in Example 10.

EXAMPLE 12

Activation of $LH_N$/B, Carrying a Thrombin Protease Processing Site, to Yield a Di-Chain Fragment As in SEQ ID 99/100 an $LH_N$/B carrying a thrombin site in the linker between the L and $H_N$ domains was expressed from pMAL c2x essentially as described in Example 5. The purified $LH_N$/B fragment was incubated with 1 unit thrombin per mg protein for 20 hours at 25° C. The di-chain $LH_N$ was separated form the thrombin by further purification on a Q-sepharose column as described in Example 5

EXAMPLE 13

Activation of $LH_N$TeNT Carrying an Enterokinase Processing Site to Yield a Di-Chain Fragment To prepare activated di-chain $LH_N$ the purified protein (e.g. obtained from SEQ ID 144/145) was treated with enterokinase at a concentration of 1 enzyme unit per 50 µg purified protein at 25° C. for 20 hours. The activated di-chain $LH_N$ was then purified from the enterokinase by ion exchange on a Q-sepharose column under identical conditions to that used for the purification following factor Xa cleavage (as described in Example 5) or using a benzamidine sepharose column equilibrated in 20 mM Hepes 100 mM NaCl pH7.2 to specifically bind and remove the enterokinase.

---

SEQUENCE LISTING (184 sequences)

SEQ ID NO: 1 - DNA, 2616 bp, Clostridium botulinum
  CDS (1)..(2616)
atgcagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtaa

SEQ ID NO: 2 - protein, 871 aa, Clostridium botulinum
MQFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 3 - DNA, 2685 bp, Clostridium botulinum
  CDS (1)..(2685)
ggatccccaggaattcatatgacgtcgacgcgtctgcagaagcttctagaattcgagctcccgggtaccatggagttcgtgaacaagcagttcaactataaggaccctgtaaacggtgttgacattgcctacatcaaaattccaaagtacggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtaa

SEQ ID NO: 4 - protein, 894 aa, Clostridium botulinum
GSPGIHMTSTRLQKLLEFELPGTMEFVNKQFNYKDPVNGVDIAYIKIPKYGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 5 - DNA, 2622 bp, Clostridium botulinum
  CDS (1)..(2622)
ggatccatggagttcgtgaacaagcagttcaactataaggaccctgtaaacggtgttgacattgcctacatcaaaattccaaagtacggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtaa

SEQ ID NO: 6 - protein, 873 aa, Clostridium botulinum
GSMEFVNKQFNYKDPVNGVDIAYIKIPKYGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 7 - DNA, 2613 bp, Clostridium botulinum
  CDS (1)..(2613)
atgccatttgttaataaacaatttaattataaagatcctgtaaatggtgttgatattgcttatataaaaattccaaatgcaggacaaatgcaaccagtaaaagcttttaaaattcataataaaatatgggttattccagaaagagatacatttacaaatcctgaagaaggagatttaaatccaccaccagaagcaaaacaagttccagtttcatattatgattcaacatatttaagtacagataatgaaaaagataattatttaaagggagttacaaaattatttgagagaatttattcaactgatcttggaagaatgttgttaacatcaatagtaaggggaataccattttggggtggaagtacaatagatacagaattaaaagttattgatactaattgtattaatgtgatacaaccagatggtagttatagatcagaagaacttaatctagtaataataggaccctcagctgatattatacagtttgaatgtaaaagctttggacatgaagttttgaatcttacgcgaaatggttatggctctactcaatacattagatttagcccagattttacatttggttttgaggagtcacttgaagttgatacaaatcctcttttaggtgcaggcaaatttgctacagatccagcagtaacattagcacatgaacttatacatgctggacatagattatatggaatagcaattaatccaaatagggtttttaaagtaaatactaatgcctattatgaaatgagtgggttagaagtaagctttgaggaacttagaacatttgggggacatgatgcaaagtttatagatagtttacaggaaaacgaatttcgtctatattattataataagtttaaagatatagcaagtacacttaataaagctaaatcaatagtaggtactactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaag

SEQ ID NO: 8 - protein, 871 aa, Clostridium botulinum
MPFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 9 - DNA, 2628 bp, Clostridium botulinum
  CDS (1)..(2628)
atgcagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataagagcgctgatggggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtaa

SEQ ID NO: 10 - protein, 875 aa, Clostridium botulinum
MQFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKSADGALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 11 - DNA, 2637 bp, Clostridium botulinum
  CDS (1)..(2637)
atgcagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataagatcgaaggtcgttgcgatggggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtaa

SEQ ID NO: 12 - protein, 878 aa, Clostridium botulinum
MQFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKIEGRCDGALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 13 - DNA, 2862 bp, Clostridium botulinum
  CDS (1)..(2862)
atgcagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataagatcgaaggtcgttgcgatggggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtctaggcctggaccggagacgctctgcggggctgagctggtggatgctcttcagttcgtgtgtggagacaggggcttttatttcaacaagcccacagggtatggctccagcagtcggagggcgcctcagacaggtatcgtggatgagtgctgcttccggagctgtgatctaaggaggctggagatgtattgcgcacccctcaagcctgccaagtcagctgaagcttag

SEQ ID NO: 14 - protein, 953 aa, Clostridium botulinum
MQFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKIEGRCDGALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKSRPGPETLCGAELVDALQFVCGDRGFYFNKPTGYGSSSRRAPQTGIVDECCFRSCDLRRLEMYCAPLKPAKSAEA

SEQ ID NO: 15 - DNA, 2724 bp, Clostridium botulinum
  CDS (1)..(2724)
atgcagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataagatcgaaggtcgttgcgatggggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtctaggcctcaatctaaagttaaaagacaaatattttcaggctatcaatctgatattgatacacataatagaattaaggatgaattatga

SEQ ID NO: 16 - protein, 907 aa, Clostridium botulinum
MQFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKIEGRCDGALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKSRPQSKVKRQIFSGYQSDIDTHNRIKDEL

SEQ ID NO: 17 - DNA, 3042 bp, Clostridium botulinum
  CDS (1)..(3042)
atgcagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataagatcgaaggtcgttgcgatggggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtcaggcctgaattccccgggtgcagctcattatgcgcaacacgatgaagccgtagacaacaaattcaacaaagaacaacaaaacgcgttctatgagatcttacatttacctaacttaaacgaagaacaacgaaacgccttcatccaaagtttaaaagatgacccaagccaaagcgctaaccttttagcagaagctaaaaagctaaatgatgctcaggcgccgaaagtagacaacaaattcaacaaagaacaacaaaacgcgttctatgagatcttacatttacctaacttaaacgaagaacaacgaaacgccttcatccaaagtttaaaagatgacccaagccaaagcgctaaccttttagcagaagctaaaaagctaaatgatgctcaggcgccgaaagtagactag

SEQ ID NO: 18 - protein, 1013 aa, Clostridium botulinum
MQFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKIEGRCDGALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKSGLNSPGAAHYAQHDEAVDNKFNKEQQNAFYEILHLPNLNEEQRNAFIQSLKDDPSQSANLLAEAKKLNDAQAPKVDNKFNKEQQNAFYEILHLPNLNEEQRNAFIQSLKDDPSQSANLLAEAKKLNDAQAPKVD

SEQ ID NO: 19 - DNA, 3509 bp, Clostridium botulinum
  CDS (1)..(3507)
atgccagttacaataaataattttaattataatgatcctattgataataataatattattatgatggagcctccatttgcgagaggtacggggagatattataaagcttttaaaatcacagatcgtatttggataataccggaaagatatacttttggatataaacctgaggattttaataaaagttccggtatttttaatagagatgtttgtgaatattatgatccagattacttaaatactaatgataaaaagaatatatttttacaaacaatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaatcagtaatccaggagaagtggagcgaaaaaaaggtattttcgcaaatttaataatatttggacctgggccagttttaaatgaaaatgagactatagatataggtatacaaaatcattttgcatcaagggaaggcttcgggggtataatgcaaatgaagttttgcccagaatatgtaagcgtatttaataatgttcaagaaaacaaaggcgcaagtatatttaatagacgtggatatttttcagatccagccttgatattaatgcatgaacttatacatgttttacatggattatatggcattaaagtagatgatttaccaattgtaccaaatgaaaaaaaattttttatgcaatctacagatgctatacaggcagaagaactatatacatttggaggacaagatcccagcatcataactccttctacggataaaagtatctatgataaagttttgcaaaattttagagggatagttgatagacttaacaaggttttagtttgcatatcagatcctaacattaatattaatatatataaaaataaatttaaagataaatataaattcgttgaagattctgagggaaaatatagtatagatgtagaaagttttgataaattatataaaagcttaatgtttggttttacagaaactaatatagcagaaaattataaaataaaaactagagcttcttattttagtgattccttaccaccagtaaaaataaaaaatttattagataatgaaatctatactatagaggaagggtttaatatatctgataaagatatggaaaaagaatatagaggtcagaataaagctataaataaacaagcttatgaagaaattagcaaggagcatttggctgtatataagatacaaatgtgtaaaagtgttaaagctccaggaatatgtattgatgttgataatgaagatttgttctttatagctgataaaaatagtttttcagatgatttatctaaaaacgaaagaatagaatataatacacagagtaattatatagaaaatgacttccctataaatgaattaattttagatactgatttaataagtaaaatagaattaccaagtgaaaatacagaatcacttactgattttaatgtagatgttccagtatatgaaaaacaacccgctataaaaaaaatttttacagatgaaaataccatctttcaatatttatactctcagacatttcctctagatataagagatataagtttaacatcttcatttgatgatgcattattattttctaacaaagtttattcatttttttctatggattatattaaaactgctaataaagtggtagaagcaggattatttgcaggttgggtgaaacagatagtaaatgattttgtaatcgaagctaataaaagcaatactatggataaaattgcagatatatctctaattgttccttatataggattagctttaaatgtaggaaatgaaacagctaaaggaaattttgaaaatgcttttgagattgcaggagccagtattctactagaatttataccagaacttttaatacctgtagttggagcctttttattagaatcatatattgacaataaaaataaaattattaaaacaatagataatgctttaactaaaagaaatgaaaaatggagtgatatgtacggattaatagtagcgcaatggctctcaacagttaatactcaattttatacaataaaagagggaatgtataaggctttaaattatcaagcacaagcattggaagaaataataaaatacagatataatatatattctgaaaaagaaaagtcaaatattaacatcgattttaatgatataaattctaaacttaatgagggtattaaccaagctatagataatataaataattttataaatggatgttctgtatcatatttaatgaaaaaaatgattccattagctgtagaaaaattactagactttgataatactctcaaaaaaaatttgttaaattatatagatgaaaataaattatatttgattggaagtgcagaatatgaaaaatcaaaagtaaataaatacttgaaaaccattatgccgtttgatctttcaatatataccaatgatacaatactaatagaaatgtttaataaatataatagcgaaattttaaataatattatcttaaatttaagatataaggataataatttaatagatttatcaggatatggggcaaaggtagaggtatatgatggagtcgagcttaatgataaaaatcaatttaaattaactagttcagcaaatagtaagattagagtgactcaaaatcagaatatcatatttaatagtgtgttccttgattttagcgttagcttttggataagaatacctaaatataagaatgatggtatacaaaattatattcataatgaatatacaataattaattgtatgaaaaataattcgggctggaaaatatctattaggggtaataggataatatggactttaattgatataaatggaaaaaccaaatcggtattttttgaatataacataagagaagatatatcagagtatataaatagatggttttttgtaactattactaataatttgaataacgctaaaatttatattaatggtaagctagaatcaaatacagatattaaagatataagagaagttattgctaatggtgaaataatatttaaattagatggtgatatagatagaacacaatttatttggatgaaatatttcagtatttttaatacggaattaagtcaatcaaatattgaagaaagatataaaattcaatcatatagcgaatatttaaaagatttttggggaaatcctttaatgtacaataaagaatattatatgtttaatgcggggaataaaaattcatatattaaactaaagaaagattcacctgtaggtgaaattttaacacgtagcaaatataatcaaaattctaaatatataaattatagagatttatatattggagaaaaatttattataagaagaaagtcaaattctcaatctataaatgatgatatagttagaaaagaagattatatatatctaga

SEQ ID NO: 20 - protein, 1169 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILNNIILNLRYKDNNLIDLSGYGAKVEVYDGVELNDKNQFKLTSSANSKIRVTQNQNIIFNSVFLDFSVSFWIRIPKYKNDGIQNYIHNEYTIINCMKNNSGWKISIRGNRIIWTLIDINGKTKSVFFEYNIREDISEYINRWFFVTITNNLNNAKIYINGKLESNTDIKDIREVIANGEIIFKLDGDIDRTQFIWMKYFSIFNTELSQSNIEERYKIQSYSEYLKDFWGNPLMYNKEYYMFNAGNKNSYIKLKKDSPVGEILTRSKYNQNSKYINYRDLYIGEKFIIRRKSNSQSINDDIVRKEDYIYL

SEQ ID NO: 21 - DNA, 2574 bp, Clostridium botulinum
  CDS (1)..(2574)
atgccagttacaataaataattttaattataatgatcctattgataataataatattattatgatggagcctccatttgcgagaggtacggggagatattataaagcttttaaaatcacagatcgtatttggataataccggaaagatatacttttggatataaacctgaggattttaataaaagttccggtatttttaatagagatgtttgtgaatattatgatccagattacttaaatactaatgataaaaagaatatatttttacaaacaatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaatcagtaatccaggagaagtggagcgaaaaaaaggtattttcgcaaatttaataatatttggacctgggccagttttaaatgaaaatgagactatagatataggtatacaaaatcattttgcatcaagggaaggcttcgggggtataatgcaaatgaagttttgcccagaatatgtaagcgtatttaataatgttcaagaaaacaaaggcgcaagtatatttaatagacgtggatatttttcagatccagccttgatattaatgcatgaacttatacatgttttacatggattatatggcattaaagtagatgatttaccaattgtaccaaatgaaaaaaaattttttatgcaatctacagatgctatacaggcagaagaactatatacatttggaggacaagatcccagcatcataactccttctacggataaaagtatctatgataaagttttgcaaaattttagagggatagttgatagacttaacaaggttttagtttgcatatcagatcctaacattaatattaatatatataaaaataaatttaaagataaatataaattcgttgaagattctgagggaaaatatagtatagatgtagaaagttttgataaattatataaaagcttaatgtttggttttacagaaactaatatagcagaaaattataaaataaaaactagagcttcttattttagtgattccttaccaccagtaaaaataaaaaatttattagataatgaaatctatactatagaggaagggtttaatatatctgataaagatatggaaaaagaatatagaggtcagaataaagctataaataaacaagcttatgaagaaattagcaaggagcatttggctgtatataagatacaaatgtgtaaaagtgttaaagctccaggaatatgtattgatgttgataatgaagatttgttctttatagctgataaaaatagtttttcagatgatttatctaaaaacgaaagaatagaatataatacacagagtaattatatagaaaatgacttccctataaatgaattaattttagatactgatttaataagtaaaatagaattaccaagtgaaaatacagaatcacttactgattttaatgtagatgttccagtatatgaaaaacaacccgctataaaaaaaatttttacagatgaaaataccatctttcaatatttatactctcagacatttcctctagatataagagatataagtttaacatcttcatttgatgatgcattattattttctaacaaagtttattcatttttttctatggattatattaaaactgctaataaagtggtagaagcaggattatttgcaggttgggtgaaacagatagtaaatgattttgtaatcgaagctaataaaagcaatactatggataaaattgcagatatatctctaattgttccttatataggattagctttaaatgtaggaaatgaaacagctaaaggaaattttgaaaatgcttttgagattgcaggagccagtattctactagaatttataccagaacttttaatacctgtagttggagcctttttattagaatcatatattgacaataaaaataaaattattaaaacaatagataatgctttaactaaaagaaatgaaaaatggagtgatatgtacggattaatagtagcgcaatggctctcaacagttaatactcaattttatacaataaaagagggaatgtataaggctttaaattatcaagcacaagcattggaagaaataataaaatacagatataatatatattctgaaaaagaaaagtcaaatattaacatcgattttaatgatataaattctaaacttaatgagggtattaaccaagctatagataatataaataattttataaatggatgttctgtatcatatttaatgaaaaaaatgattccattagctgtagaaaaattactagactttgataatactctcaaaaaaaatttgttaaattatatagatgaaaataaattatatttgattggaagtgcagaatatgaaaaatcaaaagtaaataaatacttgaaaaccattatgccgtttgatctttcaatatataccaatgatacaatactaatagaaatgtttaataaatataatagc

SEQ ID NO: 22 - protein, 858 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 23 - DNA, 1644 bp, Clostridium botulinum
  CDS (1)..(1644)
atgccagttacaataaataattttaattataatgatcctattgataataataatattattatgatggagcctccatttgcgagaggtacggggagatattataaagcttttaaaatcacagatcgtatttggataataccggaaagatatacttttggatataaacctgaggattttaataaaagttccggtatttttaatagagatgtttgtgaatattatgatccagattacttaaatactaatgataaaaagaatatatttttacaaacaatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaatcagtaatccaggagaagtggagcgaaaaaaaggtattttcgcaaatttaataatatttggacctgggccagttttaaatgaaaatgagactatagatataggtatacaaaatcattttgcatcaagggaaggcttcgggggtataatgcaaatgaagttttgcccagaatatgtaagcgtatttaataatgttcaagaaaacaaaggcgcaagtatatttaatagacgtggatatttttcagatccagccttgatattaatgcatgaacttatacatgttttacatggattatatggcattaaagtagatgatttaccaattgtaccaaatgaaaaaaaattttttatgcaatctacagatgctatacaggcagaagaactatatacatttggaggacaagatcccagcatcataactccttctacggataaaagtatctatgataaagttttgcaaaattttagagggatagttgatagacttaacaaggttttagtttgcatatcagatcctaacattaatattaatatatataaaaataaatttaaagataaatataaattcgttgaagattctgagggaaaatatagtatagatgtagaaagttttgataaattatataaaagcttaatgtttggttttacagaaactaatatagcagaaaattataaaataaaaactagagcttcttattttagtgattccttaccaccagtaaaaataaaaaatttattagataatgaaatctatactatagaggaagggtttaatatatctgataaagatatggaaaaagaatatagaggtcagaataaagctataaataaacaagcttatgaagaaattagcaaggagcatttggctgtatataagatacaaatgtgtaaaagtgttaaagctccaggaatatgtattgatgttgataatgaagatttgttctttatagctgataaaaatagtttttcagatgatttatctaaaaacgaaagaatagaatataatacacagagtaattatatagaaaatgacttccctataaatgaattaattttagatactgatttaataagtaaaatagaattaccaagtgaaaatacagaatcacttactgattttaatgtagatgttccagtatatgaaaaacaacccgctataaaaaaaatttttacagatgaaaataccatctttcaatatttatactctcagacatttcctcta

SEQ ID NO: 24 - protein, 548 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSVKAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPL

SEQ ID NO: 25 - DNA, 2616 bp, Clostridium botulinum; identical to SEQ ID NO: 1
  CDS (1)..(2616)

SEQ ID NO: 26 - protein, 871 aa, Clostridium botulinum; identical to SEQ ID NO: 2

SEQ ID NO: 27 - DNA, 2574 bp, Clostridium botulinum
atgccggttaccatcaacaacttcaactacaacgacccgatcgacaacaacaacatcatcatgatggaaccgccgttcgcacgtggtaccggtcgttactacaaggctttcaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaatcagtaatccaggagaagtggagcgaaaaaaaggtattttcgcaaatttaataatatttggacctgggccagttttaaatgaaaatgagactatagatataggtatacaaaatcattttgcatcaagggaaggcttcgggggtataatgcaaatgaagttttgcccagaatatgtaagcgtatttaataatgttcaagaaaacaaaggcgcaagtatatttaatagacgtggatatttttcagatccagccttgatattaatgcatgaacttatacatgttttacatggattatatggcattaaagtagatgatttaccaattgtaccaaatgaaaaaaaattttttatgcaatctacagatgctatacaggcagaagaactatatacatttggaggacaagatcccagcatcataactccttctacggataaaagtatctatgataaagttttgcaaaattttagagggatagttgatagacttaacaaggttttagtttgcatatcagatcctaacattaatattaatatatataaaaataaatttaaagataaatataaattcgttgaagattctgagggaaaatatagtatagatgtagaaagttttgataaattatataaaagcttaatgtttggttttacagaaactaatatagcagaaaattataaaataaaaactagagcttcttattttagtgattccttaccaccagtaaaaataaaaaatttattagataatgaaatctatactatagaggaagggtttaatatatctgataaagatatggaaaaagaatatagaggtcagaataaagctataaataaacaagcttatgaagaaattagcaaggagcatttggctgtatataagatacaaatgtgtaaaagtgttaaagctccaggaatatgtattgatgttgataatgaagatttgttctttatagctgataaaaatagtttttcagatgatttatctaaaaacgaaagaatagaatataatacacagagtaattatatagaaaatgacttccctataaatgaattaattttagatactgatttaataagtaaaatagaattaccaagtgaaaatacagaatcacttactgattttaatgtagatgttccagtatatgaaaaacaacccgctataaaaaaaatttttacagatgaaaataccatctttcaatatttatactctcagacatttcctctagatataagagatataagtttaacatcttcatttgatgatgcattattattttctaacaaagtttattcatttttttctatggattatattaaaactgctaataaagtggtagaagcaggattatttgcaggttgggtgaaacagatagtaaatgattttgtaatcgaagctaataaaagcaatactatggataaaattgcagatatatctctaattgttccttatataggattagctttaaatgtaggaaatgaaacagctaaaggaaattttgaaaatgcttttgagattgcaggagccagtattctactagaatttataccagaacttttaatacctgtagttggagcctttttattagaatcatatattgacaataaaaataaaattattaaaacaatagataatgctttaactaaaagaaatgaaaaatggagtgatatgtacggattaatagtagcgcaatggctctcaacagttaatactcaattttatacaataaaagagggaatgtataaggctttaaattatcaagcacaagcattggaagaaataataaaatacagatataatatatattctgaaaaagaaaagtcaaatattaacatcgattttaatgatataaattctaaacttaatgagggtattaaccaagctatagataatataaataattttataaatggatgttctgtatcatatttaatgaaaaaaatgattccattagctgtagaaaaattactagactttgataatactctcaaaaaaaatttgttaaattatatagatgaaaataaattatatttgattggaagtgcagaatatgaaaaatcaaaagtaaataaatacttgaaaaccattatgccgtttgatctttcaatatataccaatgatacaatactaatagaaatgtttaataaatataatagc

SEQ ID NO: 28 - DNA, 2574 bp, Clostridium botulinum
atgccagttacaataaataattttaattataatgatcctattgataataataatattattatgatggagcctccatttgcgagaggtacggggagatattataaagcttttaaaatcacagatcgtatttggataataccggaaagatatacttttggatataaacctgaggattttaataaaagttccggtatttttaatagagatgtttgtgaatattatgatccagattacttaaatactaatgataaaaagaatatatttttacaaacaatgatcaagttatttaatagaatcaaatcaaaaccattgggtgaaaagttattagagatgattataaatggtataccttatcttggagatagacgtgttccactcgaagagtttaacacaaacattgctagtgtaactgttaataaattaatcagtaatccaggagaagtggagcgaaaaaaaggtattttcgcaaatttaataatatttggacctgggccagttttaaatgaaaatgagactatagatataggtatacaaaatcattttgcatcaagggaaggcttcgggggtataatgcaaatgaagttttgcccagaatatgtaagcgtatttaataatgttcaagaaaacaaaggcgcaagtatatttaatagacgtggatatttttcagatccagccttgatattaatgcatgaactcatccacgtcctccacggtctctacggtatcaaagtagacgacctcccgatcgtcccgaacgaaaaaaaattcttcatgcagagcaccgacgcaatccaggcagaagaactctacaccttcggtggtcaggacccgagcatcatcaccccgagcaccgacaaaagcatctacgacaaagtcctccagaacttccgtggtatcgtcgaccgtctcaacaaagtcctcgtctgcatcagcgacccgaacatcaacatcaacatctacaaaaacaaattcaaagacaaatacaaattcgtcgaagacagcgaaggtaaatacagcatcgacgtcgagagcttcgacaaactctacaaaagcctcatgttcggtttcaccgaaaccaacatcgcagaaaactacaaaatcaaaacccgtgcaagctacttcagcgacagcctcccgccggtcaaaatcaaaaacctcctcgacaacgaaatctacaccatcgaagaaggtttcaacatcagcgacaaagacatggaaaaagaataccgtggtcagaacaaagcaatcaacaaacaagcttacgaagaaatcagcaaagaacacctcgcagtctacaaaatccagatgtgcaaaagcgtcaaagcaccgggtatctgcatcgacgttgacaacgaagacctcttcttcatcgcagacaaaaacagcttcagcgacgacctcagcaaaaacgaacgtatcgaatacaacacccagagcaactacatcgaaaacgacttcccgatcaacgaactcatcctcgacaccgacctcatcagcaaaatcgaactcccgagcgaaaacaccgaaagcctcaccgacttcaacgttgacgtcccggtctacgaaaaacagccggcaatcaaaaaaatcttcaccgacgaaaacaccatcttccagtacctctacagccagaccttcccgctagatataagagatataagtttaacatcttcatttgatgatgcattattattttctaacaaagtttattcatttttttctatggattatattaaaactgctaataaagtggtagaagcaggattatttgcaggttgggtgaaacagatagtaaatgattttgtaatcgaagctaataaaagcaatactatggataaaattgcagatatatctctaattgttccttatataggattagctttaaatgtaggaaatgaaacagctaaaggaaattttgaaaatgcttttgagattgcaggagccagtattctactagaatttataccagaacttttaatacctgtagttggagcctttttattagaatcatatattgacaataaaaataaaattattaaaacaatagataatgctttaactaaaagaaatgaaaaatggagtgatatgtacggattaatagtagcgcaatggctctcaacagttaatactcaattttatacaataaaagagggaatgtataaggctttaaattatcaagcacaagcattggaagaaataataaaatacagatataatatatattctgaaaaagaaaagtcaaatattaacatcgattttaatgatataaattctaaacttaatgagggtattaaccaagctatagataatataaataattttataaatggatgttctgtatcatatttaatgaaaaaaatgattccattagctgtagaaaaattactagactttgataatactctcaaaaaaaatttgttaaattatatagatgaaaataaattatatttgattggaagtgcagaatatgaaaaatcaaaagtaaataaatacttgaaaaccattatgccgtttgatctttcaatatataccaatgatacaatactaatagaaatgtttaataaatataatagc

SEQ ID NO: 29 - DNA, 2640 bp, Clostridium botulinum
acaagtttgtacaaaaaagcaggcttcggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggatgacgatgacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtcgacttga

SEQ ID NO: 30 - protein, 879 aa, Clostridium botulinum
TSLYKKAGFGSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLST

SEQ ID NO: 31 - DNA, 2609 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggatgacgatgacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtcgac

SEQ ID NO: 32 - protein, 866 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLL

SEQ ID NO: 33 - DNA, 2600 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtcgac

SEQ ID NO: 34 - protein, 863 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLL

SEQ ID NO: 35 - DNA, 2600 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaattagaagttttattccaaggacctaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtcgac

SEQ ID NO: 36 - protein, 863 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKLEVLFQGPNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLL

SEQ ID NO: 37 - DNA, 2600 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaattagtaccaagaggaagtaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtcgac

SEQ ID NO: 38 - protein, 863 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKLVPRGSNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLL

SEQ ID NO: 39 - DNA, 3382 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagggtggaggcggttcaggcggaggtggctctggcggtggcggatcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 40 - protein, 1127 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKGGGGSGGGGSGGGGSVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 41 - DNA, 3388 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaaggctgaagcggccgctaaagaagcggccgctaaagaagcggccgctaaagcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 42 - protein, 1129 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKAEAAAKEAAAKEAAAKAVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 43 - DNA, 3391 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggatgacgatgacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagggtggaggcggttcaggcggaggtggctctggcggtggcggatcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 44 - protein, 1130 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKGGGGSGGGGSGGGGSVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 45 - DNA, 3397 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggatgacgatgacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaaggctgaagcggccgctaaagaagcggccgctaaagaagcggccgctaaagcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 46 - protein, 1132 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKAEAAAKEAAAKEAAAKAVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 47 - DNA, 3388 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaattagtaccaagaggaagtaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaaggctgaagcggccgctaaagaagcggccgctaaagaagcggccgctaaagcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 48 - protein, 1129 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKLVPRGSNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKAEAAAKEAAAKEAAAKAVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 49 - DNA, 3382 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaattagtaccaagaggaagtaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagggtggaggcggttcaggcggaggtggctctggcggtggcggatcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 50 - protein, 1127 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKLVPRGSNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKGGGGSGGGGSGGGGSVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 51 - DNA, 3388 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaattagaagttttattccaaggacctaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaaggctgaagcggccgctaaagaagcggccgctaaagaagcggccgctaaagcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 52 - protein, 1129 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKLEVLFQGPNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKAEAAAKEAAAKEAAAKAVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 53 - DNA, 3382 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaattagaagttttattccaaggacctaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagggtggaggcggttcaggcggaggtggctctggcggtggcggatcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 54 - protein, 1127 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKLEVLFQGPNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKGGGGSGGGGSGGGGSVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 55 - DNA, 3388 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaaggctgaagcggccgctaaagaagcggccgctaaagaagcggccgctaaagcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 56 - protein, 1129 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKAEAAAKEAAAKEAAAKAVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 57 - DNA, 3382 bp, Clostridium botulinum
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctgatagaaggtagaaacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagggtggaggcggttcaggcggaggtggctctggcggtggcggatcggtggaaaccatatcgtttagcttcagcgagtttgaaccgggtaacaacgatttgaccttgcaaggtgcagccattattacacaatctggggttttacaactcaccaagattaatcaaaatggcatgccggcttgggactcaacgggccgaactctatatactaaacctgtgcacatttgggatatgaccacaggcactgtggccagctttgaaactagattctccttttccattgaacaaccctatacacgcccactccccgctgatggtttagtattctttatgggaccaacaaagtccaagccagctcaaggttatggatacctcggagtattcaacaactcaaaacaggataactcataccaaacacttgctgttgagtttgacactttcagtaacccatgggaccctccccaggttccacacattggaatcgatgtcaactccattcgatccatcaaaacccaaccttttcaattggacaatggccaagttgccaatgttgtcataaaatatgatgcttcctccaaaatcttacttgccgtgttggtttacccttccagtggagccatttacaccatcgctgaaattgtggatgtgaagcaagttcttcctgagtgggtcgacgttggtctctcgggtgcaaccggtgcacagcgagacgccgctgagacacacgacgtttattcttggtcattccatgcctcgttgccagaaacaaacg

SEQ ID NO: 58 - protein, 1127 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKGGGGSGGGGSGGGGSVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 59 - DNA, 2745 bp, Clostridium botulinum
atggaattcgttaacaaacagttcaactacaaagacccggttaacggtgttgacatcgcttacatcaaaatcccgaacgctggtcagatgcagccggttaaagctttcaaaatccacaacaaaatctgggttatcccggaacgtgacaccttcaccaacccggaagaaggtgacctgaacccgccgccggaagctaaacaggttccggtttcttactacgactctacctacctgtctaccgacaacgaaaaagacaactacctgaaaggtgttaccaaactgttcgaacgtatctactctaccgacctgggtcgtatgctgctgacctctatcgttcgtggtatcccgttctggggtggttctaccatcgacaccgaactgaaagttatcgacaccaactgcatcaacgttatccagccggacggttcttaccgttctgaagaactgaacctggttatcatcggtccgtctgctgacatcatccagttcgaatgcaaatctttcggtcacgaagttctgaacctgacccgtaacggttacggttctacccagtacatccgtttctctccggacttcaccttcggtttcgaagaatctctggaagttgacaccaacccgctgctgggtgctggtaaattcgctaccgacccggctgttaccctggctcacgaactgatccacgctggtcaccgtctgtacggtatcgctatcaacccgaaccgtgttttcaaagttaacaccaacgcttactacgaaatgtctggtctggaagtttctttcgaagaactgcgtaccttcggtggtcacgacgctaaattcatcgactctctgcaggaaaacgaattccgtctgtactactacaacaaattcaaagacatcgcttctaccctgaacaaagctaaatctatcgttggtaccaccgcttctctgcagtacatgaaaaacgttttcaaagaaaaatacctgctgtctgaagacacctctggtaaattctctgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggtttcaacctgcgtaacaccaacctggctgctaacttcaacggtcagaacaccgaaatcaacaacatgaacttcaccaaactgaaaaacttcaccggtctgttcgaattctacaaactgctgtgcgttcgtggtatcatcacctctaaaaccaaatctctggacgacgacgacaaaggttacaacaaagctctgaacgacctgtgcatcaaagttaacaactgggacctgttcttctctccgtctgaagacaacttcaccaacgacctgaacaaaggtgaagaaatcacctctgacaccaacatcgaagctgctgaagaaaacatctctctggacctgatccagcagtactacctgaccttcaacttcgacaacgaaccggaaaacatctctatcgaaaacctgtcttctgacatcatcggtcagctggaactgatgccgaacatcgaacgtttcccgaacggtaaaaaatacgaactggacaaatacaccatgttccactacctgcgtgctcaggaattcgaacacggtaaatctcgtatcgctctgaccaactctgttaacgaagctctgctgaacccgtctcgtgtttacaccttcttctcttctgactacgttaaaaaagttaacaaagctaccgaagctgctatgttcctgggttgggttgaacagctggtttacgacttcaccgacgaaacctctgaagtttctaccaccgacaaaatcgctgacatcaccatcatcatcccgtacatcggtccggctctgaacatcggtaacatgctgtacaaagacgacttcgttggtgctctgatcttctctggtgctgttatcctgctggaattcatcccggaaatcgctatcccggttctgggtaccttcgctctggtttcttacatcgctaacaaagttctgaccgttcagaccatcgacaacgctctgtctaaacgtaacgaaaaatgggacgaagtttacaaatacatcgttaccaactggctggctaaagttaacacccagatcgacctgatccgtaaaaaaatgaaagaagctctggaaaaccaggctgaagctaccaaagctatcatcaactaccagtacaaccagtacaccgaagaagaaaaaaacaacatcaacttcaacatcgacgacctgtcttctaaactgaacgaatctatcaacaaagctatgatcaacatcaacaaattcctgaaccagtgctctgtttcttacctgatgaactctatgatcccgtacggtgttaaacgtctggaagacttcgacgcttctctgaaagacgctctgctgaaatacatctacgacaaccgtggtaccctgatcggtcaggttgaccgtctgaaagacaaagttaacaacaccctgtctaccgacatcccgttccagctgtctaaatacgttgacaaccagcgtctgctgtctacctgcggtggtctgaccgacaccctgcaggctgaaaccgaccagctggaagacgaaaaatctgctctgcagaccgaaatcgctaacctgctgaaagaaaaagaaaaactggaattcatcctggctgctcacggtggttgctga

SEQ ID NO: 60 - protein, 914 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTCGGLTDTLQAETDQLEDEKSALQTEIANLLKEKEKLEFILAAHGGC

SEQ ID NO: 61 - DNA, 2643 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggatgacgatgacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgtcgacctgcgaagaagaagaagaagaagaagaatgctga

SEQ ID NO: 62 - protein, 878 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTCEEEEEEEEC

SEQ ID NO: 63 - DNA, 2727 bp, Clostridium botulinum
atggaattcgttaacaaacagttcaactacaaagacccggttaacggtgttgacatcgcttacatcaaaatcccgaacgctggtcagatgcagccggttaaagctttcaaaatccacaacaaaatctgggttatcccggaacgtgacaccttcaccaacccggaagaaggtgacctgaacccgccgccggaagctaaacaggttccggtttcttactacgactctacctacctgtctaccgacaacgaaaaagacaactacctgaaaggtgttaccaaactgttcgaacgtatctactctaccgacctgggtcgtatgctgctgacctctatcgttcgtggtatcccgttctggggtggttctaccatcgacaccgaactgaaagttatcgacaccaactgcatcaacgttatccagccggacggttcttaccgttctgaagaactgaacctggttatcatcggtccgtctgctgacatcatccagttcgaatgcaaatctttcggtcacgaagttctgaacctgacccgtaacggttacggttctacccagtacatccgtttctctccggacttcaccttcggtttcgaagaatctctggaagttgacaccaacccgctgctgggtgctggtaaattcgctaccgacccggctgttaccctggctcacgaactgatccacgctggtcaccgtctgtacggtatcgctatcaacccgaaccgtgttttcaaagttaacaccaacgcttactacgaaatgtctggtctggaagtttctttcgaagaactgcgtaccttcggtggtcacgacgctaaattcatcgactctctgcaggaaaacgaattccgtctgtactactacaacaaattcaaagacatcgcttctaccctgaacaaagctaaatctatcgttggtaccaccgcttctctgcagtacatgaaaaacgttttcaaagaaaaatacctgctgtctgaagacacctctggtaaattctctgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggtttcaacctgcgtaacaccaacctggctgctaacttcaacggtcagaacaccgaaatcaacaacatgaacttcaccaaactgaaaaacttcaccggtctgttcgaattctacaaactgctgtgcgttcgtggtatcatcacctctaaaaccaaatctctggacgacgacgacaaaggttacaacaaagctctgaacgacctgtgcatcaaagttaacaactgggacctgttcttctctccgtctgaagacaacttcaccaacgacctgaacaaaggtgaagaaatcacctctgacaccaacatcgaagctgctgaagaaaacatctctctggacctgatccagcagtactacctgaccttcaacttcgacaacgaaccggaaaacatctctatcgaaaacctgtcttctgacatcatcggtcagctggaactgatgccgaacatcgaacgtttcccgaacggtaaaaaatacgaactggacaaatacaccatgttccactacctgcgtgctcaggaattcgaacacggtaaatctcgtatcgctctgaccaactctgttaacgaagctctgctgaacccgtctcgtgtttacaccttcttctcttctgactacgttaaaaaagttaacaaagctaccgaagctgctatgttcctgggttgggttgaacagctggtttacgacttcaccgacgaaacctctgaagtttctaccaccgacaaaatcgctgacatcaccatcatcatcccgtacatcggtccggctctgaacatcggtaacatgctgtacaaagacgacttcgttggtgctctgatcttctctggtgctgttatcctgctggaattcatcccggaaatcgctatcccggttctgggtaccttcgctctggtttcttacatcgctaacaaagttctgaccgttcagaccatcgacaacgctctgtctaaacgtaacgaaaaatgggacgaagtttacaaatacatcgttaccaactggctggctaaagttaacacccagatcgacctgatccgtaaaaaaatgaaagaagctctggaaaaccaggctgaagctaccaaagctatcatcaactaccagtacaaccagtacaccgaagaagaaaaaaacaacatcaacttcaacatcgacgacctgtcttctaaactgaacgaatctatcaacaaagctatgatcaacatcaacaaattcctgaaccagtgctctgtttcttacctgatgaactctatgatcccgtacggtgttaaacgtctggaagacttcgacgcttctctgaaagacgctctgctgaaatacatctacgacaaccgtggtaccctgatcggtcaggttgaccgtctgaaagacaaagttaacaacaccctgtctaccgacatcccgttccagctgtctaaatacgttgacaaccagcgtctgctgtctaccctgaccgacaccctgcaggctgaaaccgaccagctggaagacgaaaaatctgctctgcagaccgaaatcgctaacctgctgaaagaaaaagaaaaactggaattcatcctggctgctcactga

SEQ ID NO: 64 - protein, 908 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTLTDTLQAETDQLEDEKSALQTEIANLLKEKEKLEFILAAH

SEQ ID NO: 65 - DNA, 2631 bp, Clostridium botulinum
atggaattcgttaacaaacagttcaactacaaagacccggttaacggtgttgacatcgcttacatcaaaatcccgaacgctggtcagatgcagccggttaaagctttcaaaatccacaacaaaatctgggttatcccggaacgtgacaccttcaccaacccggaagaaggtgacctgaacccgccgccggaagctaaacaggttccggtttcttactacgactctacctacctgtctaccgacaacgaaaaagacaactacctgaaaggtgttaccaaactgttcgaacgtatctactctaccgacctgggtcgtatgctgctgacctctatcgttcgtggtatcccgttctggggtggttctaccatcgacaccgaactgaaagttatcgacaccaactgcatcaacgttatccagccggacggttcttaccgttctgaagaactgaacctggttatcatcggtccgtctgctgacatcatccagttcgaatgcaaatctttcggtcacgaagttctgaacctgacccgtaacggttacggttctacccagtacatccgtttctctccggacttcaccttcggtttcgaagaatctctggaagttgacaccaacccgctgctgggtgctggtaaattcgctaccgacccggctgttaccctggctcacgaactgatccacgctggtcaccgtctgtacggtatcgctatcaacccgaaccgtgttttcaaagttaacaccaacgcttactacgaaatgtctggtctggaagtttctttcgaagaactgcgtaccttcggtggtcacgacgctaaattcatcgactctctgcaggaaaacgaattccgtctgtactactacaacaaattcaaagacatcgcttctaccctgaacaaagctaaatctatcgttggtaccaccgcttctctgcagtacatgaaaaacgttttcaaagaaaaatacctgctgtctgaagacacctctggtaaattctctgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggtttcaacctgcgtaacaccaacctggctgctaacttcaacggtcagaacaccgaaatcaacaacatgaacttcaccaaactgaaaaacttcaccggtctgttcgaattctacaaactgctgtgcgttcgtggtatcatcacctctaaaaccaaatctctggacgacgacgacaaaggttacaacaaagctctgaacgacctgtgcatcaaagttaacaactgggacctgttcttctctccgtctgaagacaacttcaccaacgacctgaacaaaggtgaagaaatcacctctgacaccaacatcgaagctgctgaagaaaacatctctctggacctgatccagcagtactacctgaccttcaacttcgacaacgaaccggaaaacatctctatcgaaaacctgtcttctgacatcatcggtcagctggaactgatgccgaacatcgaacgtttcccgaacggtaaaaaatacgaactggacaaatacaccatgttccactacctgcgtgctcaggaattcgaacacggtaaatctcgtatcgctctgaccaactctgttaacgaagctctgctgaacccgtctcgtgtttacaccttcttctcttctgactacgttaaaaaagttaacaaagctaccgaagctgctatgttcctgggttgggttgaacagctggtttacgacttcaccgacgaaacctctgaagtttctaccaccgacaaaatcgctgacatcaccatcatcatcccgtacatcggtccggctctgaacatcggtaacatgctgtacaaagacgacttcgttggtgctctgatcttctctggtgctgttatcctgctggaattcatcccggaaatcgctatcccggttctgggtaccttcgctctggtttcttacatcgctaacaaagttctgaccgttcagaccatcgacaacgctctgtctaaacgtaacgaaaaatgggacgaagtttacaaatacatcgttaccaactggctggctaaagttaacacccagatcgacctgatccgtaaaaaaatgaaagaagctctggaaaaccaggctgaagctaccaaagctatcatcaactaccagtacaaccagtacaccgaagaagaaaaaaacaacatcaacttcaacatcgacgacctgtcttctaaactgaacgaatctatcaacaaagctatgatcaacatcaacaaattcctgaaccagtgctctgtttcttacctgatgaactctatgatcccgtacggtgttaaacgtctggaagacttcgacgcttctctgaaagacgctctgctgaaatacatctacgacaaccgtggtaccctgatcggtcaggttgaccgtctgaaagacaaagttaacaacaccctgtctaccgacatcccgttccagctgtctaaatacgttgacaaccagcgtctgctgtctaccgaagaagaagaagaagaagaagaatga

SEQ ID NO: 66 - protein, 876 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTEEEEEEEE

SEQ ID NO: 67 - DNA, 2850 bp, Clostridium botulinum
atggaattcgttaacaaacagttcaactacaaagacccggttaacggtgttgacatcgcttacatcaaaatcccgaacgctggtcagatgcagccggttaaagctttcaaaatccacaacaaaatctgggttatcccggaacgtgacaccttcaccaacccggaagaaggtgacctgaacccgccgccggaagctaaacaggttccggtttcttactacgactctacctacctgtctaccgacaacgaaaaagacaactacctgaaaggtgttaccaaactgttcgaacgtatctactctaccgacctgggtcgtatgctgctgacctctatcgttcgtggtatcccgttctggggtggttctaccatcgacaccgaactgaaagttatcgacaccaactgcatcaacgttatccagccggacggttcttaccgttctgaagaactgaacctggttatcatcggtccgtctgctgacatcatccagttcgaatgcaaatctttcggtcacgaagttctgaacctgacccgtaacggttacggttctacccagtacatccgtttctctccggacttcaccttcggtttcgaagaatctctggaagttgacaccaacccgctgctgggtgctggtaaattcgctaccgacccggctgttaccctggctcacgaactgatccacgctggtcaccgtctgtacggtatcgctatcaacccgaaccgtgttttcaaagttaacaccaacgcttactacgaaatgtctggtctggaagtttctttcgaagaactgcgtaccttcggtggtcacgacgctaaattcatcgactctctgcaggaaaacgaattccgtctgtactactacaacaaattcaaagacatcgcttctaccctgaacaaagctaaatctatcgttggtaccaccgcttctctgcagtacatgaaaaacgttttcaaagaaaaatacctgctgtctgaagacacctctggtaaattctctgttgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggtttcaacctgcgtaacaccaacctggctgctaacttcaacggtcagaacaccgaaatcaacaacatgaacttcaccaaactgaaaaacttcaccggtctgttcgaattctacaaactgctgtgcgttcgtggtatcatcacctctaaaaccaaatctctggacgacgacgacaaaggttacaacaaagctctgaacgacctgtgcatcaaagttaacaactgggacctgttcttctctccgtctgaagacaacttcaccaacgacctgaacaaaggtgaagaaatcacctctgacaccaacatcgaagctgctgaagaaaacatctctctggacctgatccagcagtactacctgaccttcaacttcgacaacgaaccggaaaacatctctatcgaaaacctgtcttctgacatcatcggtcagctggaactgatgccgaacatcgaacgtttcccgaacggtaaaaaatacgaactggacaaatacaccatgttccactacctgcgtgctcaggaattcgaacacggtaaatctcgtatcgctctgaccaactctgttaacgaagctctgctgaacccgtctcgtgtttacaccttcttctcttctgactacgttaaaaaagttaacaaagctaccgaagctgctatgttcctgggttgggttgaacagctggtttacgacttcaccgacgaaacctctgaagtttctaccaccgacaaaatcgctgacatcaccatcatcatcccgtacatcggtccggctctgaacatcggtaacatgctgtacaaagacgacttcgttggtgctctgatcttctctggtgctgttatcctgctggaattcatcccggaaatcgctatcccggttctgggtaccttcgctctggtttcttacatcgctaacaaagttctgaccgttcagaccatcgacaacgctctgtctaaacgtaacgaaaaatgggacgaagtttacaaatacatcgttaccaactggctggctaaagttaacacccagatcgacctgatccgtaaaaaaatgaaagaagctctggaaaaccaggctgaagctaccaaagctatcatcaactaccagtacaaccagtacaccgaagaagaaaaaaacaacatcaacttcaacatcgacgacctgtcttctaaactgaacgaatctatcaacaaagctatgatcaacatcaacaaattcctgaaccagtgctctgtttcttacctgatgaactctatgatcccgtacggtgttaaacgtctggaagacttcgacgcttctctgaaagacgctctgctgaaatacatctacgacaaccgtggtaccctgatcggtcaggttgaccgtctgaaagacaaagttaacaacaccctgtctaccgacatcccgttccagctgtctaaatacgttgacaaccagcgtctgctgtctacctgcatctctggtgactctctgatctctctggcttctaccggtaaacgtgtttctatcaaagacctgctggacgaaaaagacttcgaaatctgggctatcaacgaacagaccatgaaactggaatctgctaaagtttctcgtgttttctgcaccggtaaaaaactggtttacatcctgaaaacccgtctgggtcgtaccatcaaagctaccgctaaccaccgtttcctgaccatcgacggttggtga

SEQ ID NO: 68 - protein, 949 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTCISGDSLISLASTGKRVSIKDLLDEKDFEIWAINEQTMKLESAKVSRVFCTGKKLVYILKTRLGRTIKATANHRFLTIDGW

SEQ ID NO: 69 - DNA, 1385 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggatgacgatgacaaaggttataacaaagcgctgaacgacctctgtgggtcgac

SEQ ID NO: 70 - protein, 457 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDDDDKGYNKALNDLC

SEQ ID NO: 71 - DNA, 1376 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctgatagaaggtagaaacaaagcgctgaacgacctctgtgggtcgac

SEQ ID NO: 72 - protein, 454 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLIEGRNKALNDLC

SEQ ID NO: 73 - DNA, 1376 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtgggtcgac

SEQ ID NO: 74 - protein, 454 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLC

SEQ ID NO: 75 - DNA, 1376 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaattagaagttttattccaaggacctaacaaagcgctgaacgacctctgtgggtcgac

SEQ ID NO: 76 - protein, 454 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKLEVLFQGPNKALNDLC

SEQ ID NO: 77 - DNA, 1376 bp, Clostridium botulinum
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaattagtaccaagaggaagtaacaaagcgctgaacgacctctgtgggtcgac

SEQ ID NO: 78 - protein, 454 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKLVPRGSNKALNDLC

SEQ ID NO: 79 - DNA, 2601 bp, Clostridium botulinum
atttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgtaaatctgacgacgacgacaaagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgcctagggaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 80 - protein, 867 aa, Clostridium botulinum
ISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSDDDDKAPGICIDVDNEDLFFIADKNSFSDDLSKNERIEYNTQSNYIENDFPINELILDTDLISKIELPRENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 81 - DNA, 2628 bp, Clostridium botulinum
atttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcaaatctgaagaaaagctttacgacgacgacgacaaagaccgttggggttcttcgcgtatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgcctagggaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 82 - protein, 876 aa, Clostridium botulinum
ISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSEEKLYDDDDKDRWGSSRICIDVDNEDLFFIADKNSFSDDLSKNERIEYNTQSNYIENDFPINELILDTDLISKIELPRENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 83 - DNA, 2613 bp, Clostridium botulinum
ggaagagccatgggcggccgcgaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 84 - protein, 871 aa, Clostridium botulinum
GRAMGGREFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 85 - DNA, 2613 bp, Clostridium botulinum
ggtatcgagggaaggatttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 86 - protein, 871 aa, Clostridium botulinum
GIEGRISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 87 - DNA, 2598 bp, Clostridium botulinum
atttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 88 - protein, 866 aa, Clostridium botulinum
ISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 89 - DNA, 2613 bp, Clostridium botulinum
gacgacgacgacaaaatttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 90 - protein, 871 aa, Clostridium botulinum
DDDDKISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 91 - DNA, 2610 bp, Clostridium botulinum
atcgagggaaggatttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 92 - protein, 870 aa, Clostridium botulinum
IEGRISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 93 - DNA, 2586 bp, Clostridium botulinum
ggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 94 - protein, 862 aa, Clostridium botulinum
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 95 - DNA, 2601 bp, Clostridium botulinum
agtccgggagctcgtggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 96 - protein, 867 aa, Clostridium botulinum
SPGARGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 97 - DNA, 2601 bp, Clostridium botulinum
gccatggctgatatcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 98 - protein, 867 aa, Clostridium botulinum
AMADIGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 99 - DNA, 2595 bp, Clostridium botulinum
atttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcggtctggttccgcgtggttctggtccgtgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgcctagggaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 100 - protein, 865 aa, Clostridium botulinum
ISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCGLVPRGSGPCIDVDNEDLFFIADKNSFSDDLSKNERIEYNTQSNYIENDFPINELILDTDLISKIELPRENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 101 - DNA, 2592 bp, Clostridium botulinum
atttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgtgaaaacctgtacttccagggtatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgcctagggaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 102 - protein, 864 aa, Clostridium botulinum
ISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCENLYFQGICIDVDNEDLFFIADKNSFSDDLSKNERIEYNTQSNYIENDFPINELILDTDLISKIELPRENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 103 - DNA, 2598 bp, Clostridium botulinum
atttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgcctagggaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 104 - protein, 866 aa, Clostridium botulinum
ISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPRENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 105 - DNA, 2628 bp, Clostridium botulinum
atttcagaattcggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcaaatctgaagaaaagctttacgacgacgacgacaaagaccgttggggttcttcgcgtatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 106 - protein, 876 aa, Clostridium botulinum
ISEFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSEEKLYDDDDKDRWGSSRICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 107 - DNA, 2628 bp, Clostridium botulinum
atttcagaattcggatccatgccggttaccatcaacaacttcaactacaacgacccgatcgacaacaacaacatcatcatgatggaaccgccgttcgcacgtggtaccggtcgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgatcaaactcttcaaccgtatcaaaagcaaaccgctcggtgaaaaactcctcgaaatgattatcaacggtatcccgtacctcggtgaccgtcgtgtcccgctcgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagcgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgcaaatctgaagaaaagctttacgacgacgacgacaaagaccgttggggttcttcgcgtatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 108 - protein, 876 aa, Clostridium botulinum; identical to SEQ ID NO: 106

SEQ ID NO: 109 - DNA, 4260 bp, Clostridium botulinum
atgaaaactgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccaccatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatttcagaattccgcgagtccggagctatctctggcgatagtctgatcagcctggctagcacaggaaaaagagtttctattaaagatttgttagatgaaaaagattttgaaatatgggcaattaatgaacagacgatgaagctagaatcagctaaagttagtcgtgtattttgtactggcaaaaagctagtttatattctaaaaactcgactaggtagaactatcaaggcaacagcaaatcatagatttttaactattgatggttggaaaagattagatgagctatctttaaaagagcatattgctctaccccgtaaactagaaagctcctctttacaattgtcaccagaaatagaaaagttgtctcagagtgatatttactgggactccatcgtttctattacggagactggagtcgaagaggtttttgatttgactgtgccaggaccacataactttgtcgcgaatgacatcattgtacacaacggaagagccatgggcggccgcgaatttggatccatgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgcctagggaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagc

SEQ ID NO: 110 - protein, 1420 aa, Clostridium botulinum
MKTEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISEFRESGAISGDSLISLASTGKRVSIKDLLDEKDFEIWAINEQTMKLESAKVSRVFCTGKKLVYILKTRLGRTIKATANHRFLTIDGWKRLDELSLKEHIALPRKLESSSLQLSPEIEKLSQSDIYWDSIVSITETGVEEVFDLTVPGPHNFVANDIIVHNGRAMGGREFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPRENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 111 - DNA, 2664 bp, Clostridium botulinum
acaagtttgtacaaaaaagcaggcttcggatccatgccggttaccatcaacaacttcaactacaacgacccgatcgacaacaacaacatcatcatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgctcgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagcgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgtaaatctgacgacgacgacaaagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgcctagggaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagcgagatcttgtcgactctagacgacccagctttcttgtacaaagtggtc

SEQ ID NO: 112 - protein, 888 aa, Clostridium botulinum
TSLYKKAGFGSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSDDDDKAPGICIDVDNEDLFFIADKNSFSDDLSKNERIEYNTQSNYIENDFPINELILDTDLISKIELPRENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNSEILSTLDDPAFLYKVV

SEQ ID NO: 113 - DNA, 1375 bp, Clostridium botulinum
ggatccatgccggttaccatcaacaacttcaactacaacgacccgatcgacaacaacaacatcatcatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgctcgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagcgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacacaattgaagagggcttcaacatcagtgacaaagacatggagaaggaatacagaggtcagaacaaggctatcaacaaacaggcatacgaggagatcagcaaagaacacctcgcagtctacaagatccagatgtgtaaatctgacgacgacgacaaagctcccgggatctgcatcgacgttgacaacgagatct

SEQ ID NO: 114 - protein, 458 aa, Clostridium botulinum
GSMPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCKSDDDDKAPGICIDVDNEI

SEQ ID NO: 115 - DNA, 2739 bp, Clostridium botulinum
atcacaagtttgtacaaaaaagcaggcttcggatccctcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaatctgcagactctagacgacccagctttcttgtacaaagtggtgatatttcagaattcggatcctctagacgaagaagaagaagaagaagaagaataa

SEQ ID NO: 116 - protein, 912 aa, Clostridium botulinum
ITSLYKKAGFGSLDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLQTLDDPAFLYKVVIFQNSDPLDEEEEEEEE

SEQ ID NO: 117 - DNA, 2853 bp, Clostridium botulinum
atcacctctctgtacaaaaaagctggtttcggttctctggaccacatgccgatcaccatcaacaacttcaactactctgacccggttgacaacaaaaacatcctgtacctggacacccacctgaacaccctggctaacgaaccggaaaaagctttccgtatcaccggtaacatctgggttatcccggaccgtttctctcgtaactctaacccgaacctgaacaaaccgccgcgtgttacctctccgaaatctggttactacgacccgaactacctgtctaccgactctgacaaagacaccttcctgaaagaaatcatcaaactgttcaaacgtatcaactctcgtgaaatcggtgaagaactgatctaccgtctgtctaccgacatcccgttcccgggtaacaacaacaccccgatcaacaccttcgacttcgacgttgacttcaactctgttgacgttaaaacccgtcagggtaacaactgggttaaaaccggttctatcaacccgtctgttatcatcaccggtccgcgtgaaaacatcatcgacccggaaacctctaccttcaaactgaccaacaacaccttcgctgctcaggaaggtttcggtgctctgtctatcatctctatctctccgcgtttcatgctgacctactctaacgctaccaacgacgttggtgaaggtcgtttctctaaatctgaattctgcatggacccgatcctgatcctgatgcacgaactgaaccacgctatgcacaacctgtacggtatcgctatcccgaacgaccagaccatctcttctgttacctctaacatcttctactctcagtacaacgttaaactggaatacgctgaaatctacgctttcggtggtccgaccatcgacctgatcccgaaatctgctcgtaaatacttcgaagaaaaagctctggactactaccgttctatcgctaaacgtctgaactctatcaccaccgctaacccgtcttctttcaacaaatacatcggtgaatacaaacagaaactgatccgtaaataccgtttcgttgttgaatcttctggtgaagttaccgttaaccgtaacaaattcgttgaactgtacaacgaactgacccagatcttcaccgaattcaactacgctaaaatctacaacgttcagaaccgtaaaatctacctgtctaacgtttacaccccggttaccgctaacatcctggacgacaacgtttacgacatccagaacggtttcaacatcccgaaatctaacctgaacgttctgttcatgggtcagaacctgtctcgtaacccggctctgcgtaaagttaacccggaaaacatgctgtacctgttcaccaaattctgccacaaagctatcgacggtcgttctctgtacaacaaaaccctggactgccgtgaactgctggttaaaaacaccgacctgccgttcatcggtgacatctctgacgttaaaaccgacatcttcctgcgtaaagacatcaacgaagaaaccgaagttatctactacccggacaacgtttctgttgaccaggttatcctgtctaaaaacacctctgaacacggtcagctggacctgctgtacccgtctatcgactctgaatctgaaatcctgccgggtgaaaaccaggttttctacgacaaccgtacccagaacgttgactacctgaactcttactactacctggaatctcagaaactgtctgacaacgttgaagacttcaccttcacccgttctatcgaagaagctctggacaactctgctaaagtttacacctacttcccgaccctggctaacaaagttaacgctggtgttcagggtggtctgttcctgatgtgggctaacgacgttgttgaagacttcaccaccaacatcctgcgtaaagacaccctggacaaaatctctgacgtttctgctatcatcccgtacatcggtccggctctgaacatctctaactctgttcgtcgtggtaacttcaccgaagctttcgctgttaccggtgttaccatcctgctggaagctttcccggaattcaccatcccggctctgggtgctttcgttatctactctaaagttcaggaacgtaacgaaatcatcaaaaccatcgacaactgcctggaacagcgtatcaaacgttggaaagactcttacgaatggatgatgggtacctggctgtctcgtatcatcacccagttcaacaacatctcttaccagatgtacgactctctgaactaccaggctggtgctatcaaagctaaaatcgacctggaatacaaaaaatactctggttctgacaaagaaaacatcaaatctcaggttgaaaacctgaaaaactctctggacgttaaaatctctgaagctatgaacaacatcaacaaattcatccgtgaatgctctgttacctacctgttcaaaaacatgctgccgaaagttatcgacgaactgaacgaattcgaccgtaacaccaaagctaaactgatcaacctgatcgactctcacaacatcatcctggttggtgaagttgacaaactgaaagctaaagttaacaactctttccagaacaccatcccgttcaacatcttctcttacaccaacaactctctgctgaaagacatcatcaacgaatacttcaacctgcagaccctggacgacccggctttcctgtacaaagttgttatcttccagaactctgacccgctggactgcggtggtctgaccgacaccctgcaggctgaaaccgaccagctggaagacgaaaaatctgctctgcagaccgaaatcgctaacctgctgaaagaaaaagaaaaactggaattcatcctggctgctcacggtggttgctaa

SEQ ID NO: 118 - protein, 950 aa, Clostridium botulinum
ITSLYKKAGFGSLDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLQTLDDPAFLYKVVIFQNSDPLDCGGLTDTLQAETDQLEDEKSALQTEIANLLKEKEKLEFILAAHGGC

SEQ ID NO: 119 - DNA, 2745 bp, Clostridium botulinum
atcacctctctgtacaaaaaagctggtttcggttctctggaccacatgccgatcaccatcaacaacttcaactactctgacccggttgacaacaaaaacatcctgtacctggacacccacctgaacaccctggctaacgaaccggaaaaagctttccgtatcaccggtaacatctgggttatcccggaccgtttctctcgtaactctaacccgaacctgaacaaaccgccgcgtgttacctctccgaaatctggttactacgacccgaactacctgtctaccgactctgacaaagacaccttcctgaaagaaatcatcaaactgttcaaacgtatcaactctcgtgaaatcggtgaagaactgatctaccgtctgtctaccgacatcccgttcccgggtaacaacaacaccccgatcaacaccttcgacttcgacgttgacttcaactctgttgacgttaaaacccgtcagggtaacaactgggttaaaaccggttctatcaacccgtctgttatcatcaccggtccgcgtgaaaacatcatcgacccggaaacctctaccttcaaactgaccaacaacaccttcgctgctcaggaaggtttcggtgctctgtctatcatctctatctctccgcgtttcatgctgacctactctaacgctaccaacgacgttggtgaaggtcgtttctctaaatctgaattctgcatggacccgatcctgatcctgatgcacgaactgaaccacgctatgcacaacctgtacggtatcgctatcccgaacgaccagaccatctcttctgttacctctaacatcttctactctcagtacaacgttaaactggaatacgctgaaatctacgctttcggtggtccgaccatcgacctgatcccgaaatctgctcgtaaatacttcgaagaaaaagctctggactactaccgttctatcgctaaacgtctgaactctatcaccaccgctaacccgtcttctttcaacaaatacatcggtgaatacaaacagaaactgatccgtaaataccgtttcgttgttgaatcttctggtgaagttaccgttaaccgtaacaaattcgttgaactgtacaacgaactgacccagatcttcaccgaattcaactacgctaaaatctacaacgttcagaaccgtaaaatctacctgtctaacgtttacaccccggttaccgctaacatcctggacgacaacgtttacgacatccagaacggtttcaacatcccgaaatctaacctgaacgttctgttcatgggtcagaacctgtctcgtaacccggctctgcgtaaagttaacccggaaaacatgctgtacctgttcaccaaattctgccacaaagctatcgacggtcgttctctgtacaacaaaaccctggactgccgtgaactgctggttaaaaacaccgacctgccgttcatcggtgacatctctgacgttaaaaccgacatcttcctgcgtaaagacatcaacgaagaaaccgaagttatctactacccggacaacgtttctgttgaccaggttatcctgtctaaaaacacctctgaacacggtcagctggacctgctgtacccgtctatcgactctgaatctgaaatcctgccgggtgaaaaccaggttttctacgacaaccgtacccagaacgttgactacctgaactcttactactacctggaatctcagaaactgtctgacaacgttgaagacttcaccttcacccgttctatcgaagaagctctggacaactctgctaaagtttacacctacttcccgaccctggctaacaaagttaacgctggtgttcagggtggtctgttcctgatgtgggctaacgacgttgttgaagacttcaccaccaacatcctgcgtaaagacaccctggacaaaatctctgacgtttctgctatcatcccgtacatcggtccggctctgaacatctctaactctgttcgtcgtggtaacttcaccgaagctttcgctgttaccggtgttaccatcctgctggaagctttcccggaattcaccatcccggctctgggtgctttcgttatctactctaaagttcaggaacgtaacgaaatcatcaaaaccatcgacaactgcctggaacagcgtatcaaacgttggaaagactcttacgaatggatgatgggtacctggctgtctcgtatcatcacccagttcaacaacatctcttaccagatgtacgactctctgaactaccaggctggtgctatcaaagctaaaatcgacctggaatacaaaaaatactctggttctgacaaagaaaacatcaaatctcaggttgaaaacctgaaaaactctctggacgttaaaatctctgaagctatgaacaacatcaacaaattcatccgtgaatgctctgttacctacctgttcaaaaacatgctgccgaaagttatcgacgaactgaacgaattcgaccgtaacaccaaagctaaactgatcaacctgatcgactctcacaacatcatcctggttggtgaagttgacaaactgaaagctaaagttaacaactctttccagaacaccatcccgttcaacatcttctcttacaccaacaactctctgctgaaagacatcatcaacgaatacttcaacctgcagaccctggacgacccggctttcctgtacaaagttgttatcttccagaactctgacccgctggactgcgaagaagaagaagaagaagaagaatgctaa

SEQ ID NO: 120 - protein, 914 aa, Clostridium botulinum
ITSLYKKAGFGSLDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLQTLDDPAFLYKVVIFQNSDPLDCEEEEEEEEC

SEQ ID NO: 121 - DNA, 2835 bp, Clostridium botulinum
atcacctctctgtacaaaaaagctggtttcggttctctggaccacatgccgatcaccatcaacaacttcaactactctgacccggttgacaacaaaaacatcctgtacctggacacccacctgaacaccctggctaacgaaccggaaaaagctttccgtatcaccggtaacatctgggttatcccggaccgtttctctcgtaactctaacccgaacctgaacaaaccgccgcgtgttacctctccgaaatctggttactacgacccgaactacctgtctaccgactctgacaaagacaccttcctgaaagaaatcatcaaactgttcaaacgtatcaactctcgtgaaatcggtgaagaactgatctaccgtctgtctaccgacatcccgttcccgggtaacaacaacaccccgatcaacaccttcgacttcgacgttgacttcaactctgttgacgttaaaacccgtcagggtaacaactgggttaaaaccggttctatcaacccgtctgttatcatcaccggtccgcgtgaaaacatcatcgacccggaaacctctaccttcaaactgaccaacaacaccttcgctgctcaggaaggtttcggtgctctgtctatcatctctatctctccgcgtttcatgctgacctactctaacgctaccaacgacgttggtgaaggtcgtttctctaaatctgaattctgcatggacccgatcctgatcctgatgcacgaactgaaccacgctatgcacaacctgtacggtatcgctatcccgaacgaccagaccatctcttctgttacctctaacatcttctactctcagtacaacgttaaactggaatacgctgaaatctacgctttcggtggtccgaccatcgacctgatcccgaaatctgctcgtaaatacttcgaagaaaaagctctggactactaccgttctatcgctaaacgtctgaactctatcaccaccgctaacccgtcttctttcaacaaatacatcggtgaatacaaacagaaactgatccgtaaataccgtttcgttgttgaatcttctggtgaagttaccgttaaccgtaacaaattcgttgaactgtacaacgaactgacccagatcttcaccgaattcaactacgctaaaatctacaacgttcagaaccgtaaaatctacctgtctaacgtttacaccccggttaccgctaacatcctggacgacaacgtttacgacatccagaacggtttcaacatcccgaaatctaacctgaacgttctgttcatgggtcagaacctgtctcgtaacccggctctgcgtaaagttaacccggaaaacatgctgtacctgttcaccaaattctgccacaaagctatcgacggtcgttctctgtacaacaaaaccctggactgccgtgaactgctggttaaaaacaccgacctgccgttcatcggtgacatctctgacgttaaaaccgacatcttcctgcgtaaagacatcaacgaagaaaccgaagttatctactacccggacaacgtttctgttgaccaggttatcctgtctaaaaacacctctgaacacggtcagctggacctgctgtacccgtctatcgactctgaatctgaaatcctgccgggtgaaaaccaggttttctacgacaaccgtacccagaacgttgactacctgaactcttactactacctggaatctcagaaactgtctgacaacgttgaagacttcaccttcacccgttctatcgaagaagctctggacaactctgctaaagtttacacctacttcccgaccctggctaacaaagttaacgctggtgttcagggtggtctgttcctgatgtgggctaacgacgttgttgaagacttcaccaccaacatcctgcgtaaagacaccctggacaaaatctctgacgtttctgctatcatcccgtacatcggtccggctctgaacatctctaactctgttcgtcgtggtaacttcaccgaagctttcgctgttaccggtgttaccatcctgctggaagctttcccggaattcaccatcccggctctgggtgctttcgttatctactctaaagttcaggaacgtaacgaaatcatcaaaaccatcgacaactgcctggaacagcgtatcaaacgttggaaagactcttacgaatggatgatgggtacctggctgtctcgtatcatcacccagttcaacaacatctcttaccagatgtacgactctctgaactaccaggctggtgctatcaaagctaaaatcgacctggaatacaaaaaatactctggttctgacaaagaaaacatcaaatctcaggttgaaaacctgaaaaactctctggacgttaaaatctctgaagctatgaacaacatcaacaaattcatccgtgaatgctctgttacctacctgttcaaaaacatgctgccgaaagttatcgacgaactgaacgaattcgaccgtaacaccaaagctaaactgatcaacctgatcgactctcacaacatcatcctggttggtgaagttgacaaactgaaagctaaagttaacaactctttccagaacaccatcccgttcaacatcttctcttacaccaacaactctctgctgaaagacatcatcaacgaatacttcaacctgcagaccctggacgacccggctttcctgtacaaagttgttatcttccagaactctgacccgctggacctgaccgacaccctgcaggctgaaaccgaccagctggaagacgaaaaatctgctctgcagaccgaaatcgctaacctgctgaaagaaaaagaaaaactggaattcatcctggctgctcactaa

SEQ ID NO: 122 - protein, 944 aa, Clostridium botulinum
ITSLYKKAGFGSLDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLQTLDDPAFLYKVVIFQNSDPLDLTDTLQAETDQLEDEKSALQTEIANLLKEKEKLEFILAAH

SEQ ID NO: 123 - DNA, 2643 bp, Clostridium botulinum
atcacaagtttgtacaaaaaagcaggcttcggatccctcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaat

SEQ ID NO: 124 - protein, 881 aa, Clostridium botulinum
ITSLYKKAGFGSLDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 125 - DNA, 2631 bp, Clostridium botulinum
gtaccggaattcggatcctctagagtcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaat

SEQ ID NO: 126 - protein, 877 aa, Clostridium botulinum
VPEFGSSRVDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 127 - DNA, 2628 bp, Clostridium botulinum
gtagaattcggatcctctagagtcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaat

SEQ ID NO: 128 - protein, 876 aa, Clostridium botulinum
VEFGSSRVDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 129 - DNA, 2631 bp, Clostridium botulinum
atttcagaattcggatcctctagagtcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaat

SEQ ID NO: 130 - protein, 877 aa, Clostridium botulinum
ISEFGSSRVDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFN

SEQ ID NO: 131 - DNA, 2708 bp, Clostridium botulinum
atcacaagtttgtacaaaaaagcaggcttcggatccctcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaatctgcagactctagacgacccagctttcttgtacaaagtggtgatatttcagaattcggatcctct

SEQ ID NO: 132 - protein, 902 aa, Clostridium botulinum
ITSLYKKAGFGSLDHMPITINNFNYSDPVDNKNILYLDTHLNTLANEPEKAFRITGNIWVIPDRFSRNSNPNLNKPPRVTSPKSGYYDPNYLSTDSDKDTFLKEIIKLFKRINSREIGEELIYRLSTDIPFPGNNNTPINTFDFDVDFNSVDVKTRQGNNWVKTGSINPSVIITGPRENIIDPETSTFKLTNNTFAAQEGFGALSIISISPRFMLTYSNATNDVGEGRFSKSEFCMDPILILMHELNHAMHNLYGIAIPNDQTISSVTSNIFYSQYNVKLEYAEIYAFGGPTIDLIPKSARKYFEEKALDYYRSIAKRLNSITTANPSSFNKYIGEYKQKLIRKYRFVVESSGEVTVNRNKFVELYNELTQIFTEFNYAKIYNVQNRKIYLSNVYTPVTANILDDNVYDIQNGFNIPKSNLNVLFMGQNLSRNPALRKVNPENMLYLFTKFCHKAIDGRSLYNKTLDCRELLVKNTDLPFIGDISDVKTDIFLRKDINEETEVIYYPDNVSVDQVILSKNTSEHGQLDLLYPSIDSESEILPGENQVFYDNRTQNVDYLNSYYYLESQKLSDNVEDFTFTRSIEEALDNSAKVYTYFPTLANKVNAGVQGGLFLMWANDVVEDFTTNILRKDTLDKISDVSAIIPYIGPALNISNSVRRGNFTEAFAVTGVTILLEAFPEFTIPALGAFVIYSKVQERNEIIKTIDNCLEQRIKRWKDSYEWMMGTWLSRIITQFNNISYQMYDSLNYQAGAIKAKIDLEYKKYSGSDKENIKSQVENLKNSLDVKISEAMNNINKFIRECSVTYLFKNMLPKVIDELNEFDRNTKAKLINLIDSHNIILVGEVDKLKAKVNNSFQNTIPFNIFSYTNNSLLKDIINEYFNLQTLDDPAFLYKVVIFQNSDP

SEQ ID NO: 133 - DNA, 2831 bp, Clostridium botulinum
caaataatgattttattttgactgatagtgacctgttcgttgcaacaaattgatgagcaatgcttttttataatgccaactttgtacaaaaaagcaggcttcggatccctcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaatctgcagactctagacgacccagctttcttgtacaaagttggcattataagaaagcattgcttatcaatttgttgcaacgaacaggtcactatcagtcaaaataaaatcattatttg

SEQ ID NO: 134 - DNA, 3647 bp, Clostridium botulinum
gttaacgctagcatggatctcgggccccaaataatgattttattttgactgatagtgacctgttcgttgcaacaaattgatgagcaatgcttttttataatgccaactttgtacaaaaaagcaggcttcggatccctcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtctgcagactctagacgacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgc

SEQ ID NO: 135 - DNA, 5076 bp, Clostridium botulinum
gttaacgctagcatggatctcgggccccaaataatgattttattttgactgatagtgacctgttcgttgcaacaaattgatgagcaatgcttttttataatgccaactttgtacaaaaaagcaggcttcggatccctcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaattaaattaatgattcaaagggcgaattccagcacactggcggccgttactagtggatccgagctcggtaccaagcttggcactggccgtcgttttacaacgtcgtgactgggaaaaccctggcgttacccaacttaatcgccttgcagcacatccccctttcgcgagctggcgtaatagcgaagaggcccgctgcagactctagacgacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgc

SEQ ID NO: 136 - DNA, 4886 bp, Clostridium botulinum
gttaacgctagcatggatctcgggccccaaataatgattttattttgactgatagtgacctgttcgttgcaacaaattgatgagcaatgcttttttataatgccaactttgtacaaaaaagcaggcttcggatccctcgaccatatgccaataacaattaacaactttaattattcagatcctgttgataataaaaatattttatatttagatactcatttaaatacactagctaatgagcctgaaaaagcctttcgcattacaggaaatatatgggtaatacctgatagattttcaagaaattctaatccaaatttaaataaacctcctcgagttacaagccctaaaagtggttattatgatcctaattatttgagtactgattctgacaaagatacatttttaaaagaaattataaagttatttaaaagaattaattctagagaaataggagaagaattaatatatagactttcgacagatataccctttcctgggaataacaatactccaattaatacctttgattttgatgtagattttaacagtgttgatgttaaaactagacaaggtaacaactgggttaaaactggtagcataaatcctagtgttataataactggacctagagaaaacattatagatccagaaacttctacgtttaaattaactaacaatacctttgcggcacaagaaggatttggtgctttatcaataatttcaatatcacctagatttatgctaacatatagtaatgcaactaatgatgtaggagagggtagattttctaagtctgaattttgcatggatccaatactaattttaatgcatgaacttaatcatgcaatgcataatttatatggaatagctataccaaatgatcaaacaatttcatctgtaactagtaatattttttattctcaatataatgtgaaattagagtatgcagaaatatatgcatttggaggtccaactatagaccttattcctaaaagtgcaaggaaatattttgaggaaaaggcattggattattatagatctatagctaaaagacttaatagtataactactgcaaatccttcaagctttaataaatatataggggaatataaacagaaacttattagaaagtatagattcgtagtagaatcttcaggtgaagttacagtaaatcgtaataagtttgttgagttatataatgaacttacacaaatatttacagaatttaactacgctaaaatatataatgtacaaaataggaaaatatatctttcaaatgtatatactccggttacggcgaatatattagacgataatgtttatgatatacaaaatggatttaatatacctaaaagtaatttaaatgtactatttatgggtcaaaatttatctcgaaatccagcattaagaaaagtcaatcctgaaaatatgctttatttatttacaaaattttgtcataaagcaatagatggtagatcattatataataaaacattagattgtagagagcttttagttaaaaatactgacttaccctttataggtgatattagtgatgttaaaactgatatatttttaagaaaagatattaatgaagaaactgaagttatatactatccggacaatgtttcagtagatcaagttattctcagtaagaatacctcagaacatggacaactagatttattataccctagtattgacagtgagagtgaaatattaccaggggagaatcaagtcttttatgataatagaactcaaaatgttgattatttgaattcttattattacctagaatctcaaaaactaagtgataatgttgaagattttacttttacgagatcaattgaggaggctttggataatagtgcaaaagtatatacttactttcctacactagctaataaagtaaatgcgggtgttcaaggtggtttatttttaatgtgggcaaatgatgtagttgaagattttactacaaatattctaagaaaagatacattagataaaatatcagatgtatcagctattattccctatataggacccgcattaaatataagtaattctgtaagaagaggaaattttactgaagcatttgcagttactggtgtaactattttattagaagcatttcctgaatttacaatacctgcacttggtgcatttgtgatttatagtaaggttcaagaaagaaacgagattattaaaactatagataattgtttagaacaaaggattaagagatggaaagattcatatgaatggatgatgggaacgtggttatccaggattattactcaatttaataatataagttatcaaatgtatgattctttaaattatcaggcaggtgcaatcaaagctaaaatagatttagaatataaaaaatattcaggaagtgataaagaaaatataaaaagtcaagttgaaaatttaaaaaatagtttagatgtaaaaatttcggaagcaatgaataatataaataaatttatacgagaatgttccgtaacatatttatttaaaaatatgttacctaaagtaattgatgaattaaatgagtttgatcgaaatactaaagcaaaattaattaatcttatagatagtcataatattattctagttggtgaagtagataaattaaaagcaaaagtaaataatagctttcaaaatacaataccctttaatattttttcatatactaataattctttattaaaagatataattaatgaatatttcaatctgcagactctagacgacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgc

SEQ ID NO: 137 - DNA, 5558 bp, Clostridium botulinum
actgccgggcctcttgcgggatgcccaatacgcaaaccgcctctccccgcgcgttggccgattcattaatgcagctggcacgacaggtttcccgactggaaagcgggcagtgagcgcaacgcaattaatgtaagttagctcactcattaggcacaattctcatgtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagccagtccgtttaggtgttttcacgagcacttcaccaacaaggaccatagcatatgaaaatcgaagaaggtaaactggtaatctggattaacggcgataaaggctataacggtctcgctgaagtcggtaagaaattcgagaaagataccggaattaaagtcaccgttgagcatccggataaactggaagagaaattcccacaggttgcggcaactggcgatggccctgacattatcttctgggcacacgaccgctttggtggctacgctcaatctggcctgttggctgaaatcaccccggacaaagcgttccaggacaagctgtatccgtttacctgggatgccgtacgttacaacggcaagctgattgcttacccgatcgctgttgaagcgttatcgctgatttataacaaagatctgctgccgaacccgccaaaaacctgggaagagatcccggcgctggataaagaactgaaagcgaaaggtaagagcgcgctgatgttcaacctgcaagaaccgtacttcacctggccgctgattgctgctgacgggggttatgcgttcaagtatgaaaacggcaagtacgacattaaagacgtgggcgtggataacgctggcgcgaaagcgggtctgaccttcctggttgacctgattaaaaacaaacacatgaatgcagacaccgattactccatcgcagaagctgcctttaataaaggcgaaacagcgatgaccatcaacggcccgtgggcatggtccaacatcgacaccagcaaagtgaattatggtgtaacggtactgccgaccttcaagggtcaaccatccaaaccgttcgttggcgtgctgagcgcaggtattaacgccgccagtccgaacaaagagctggcaaaagagttcctcgaaaactatctgctgactgatgaaggtctggaagcggttaataaagacaaaccgctgggtgccgtagcgctgaagtcttacgaggaagagttggcgaaagatccacgtattgccgccactatggaaaacgcccagaaaggtgaaatcatgccgaacatcccgcagatgtccgctttctggtatgccgtgcgtactgcggtgatcaacgccgccagcggtcgtcagactgtcgatgaagccctgaaagacgcgcagactaattcgagctcgaacaacaacaacaataacaataacaacaacctcgggatcgagggaaggatcacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaacgcgtggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctcccttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggtgatatttcagaattcggatcctctagagtcgacctgcaggcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccactgaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatcacagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctg

SEQ ID NO: 138 - DNA, 3393 bp, Clostridium botulinum
atggaattcgttaacaaacagttcaactacaaagacccggttaacggtgttgacatcgcttacatcaaaatcccgaacgctggtcagatgcagccggttaaagctttcaaaatccacaacaaaatctgggttatcccggaacgtgacaccttcaccaacccggaagaaggtgacctgaacccgccgccggaagctaaacaggttccggtttcttactacgactctacctacctgtctaccgacaacgaaaaagacaactacctgaaaggtgttaccaaactgttcgaacgtatctactctaccgacctgggtcgtatgctgctgacctctatcgttcgtggtatcccgttctggggtggttctaccatcgacaccgaactgaaagttatcgacaccaactgcatcaacgttatccagccggacggttcttaccgttctgaagaactgaacctggttatcatcggtccgtctgctgacatcatccagttcgaatgcaaatctttcggtcacgaagttctgaacctgacccgtaacggttacggttctacccagtacatccgtttctctccggacttcaccttcggtttcgaagaatctctggaagttgacaccaacccgctgctgggtgctggtaaattcgctaccgacccggctgttaccctggctcacgaactgatccacgctggtcaccgtctgtacggtatcgctatcaacccgaaccgtgttttcaaagttaacaccaacgcttactacgaaatgtctggtctggaagtttctttcgaagaactgcgtaccttcggtggtcacgacgctaaattcatcgactctctgcaggaaaacgaattccgtctgtactactacaacaaattcaaagacatcgcttctaccctgaacaaagctaaatctatcgttggtaccaccgcttctctgcagtacatgaaaaacgttttcaaagaaaaatacctgctgtctgaagacacctctggtaaattctctgttgacgacgacgacaaactgaaattcgacaaactgtacaaaatgctgaccgaaatctacaccgaagacaacttcgttaaattcttcaaagttctgaaccgtaaaacctacctgaacttcgacaaagctgttttcaaaatcaacatcgttccgaaagttaactacaccatctacgacggtttcaacctgcgtaacaccaacctggctgctaacttcaacggtcagaacaccgaaatcaacaacatgaacttcaccaaactgaaaaacttcaccggtctgttcgaattctacaaactgctgtgcgttcgtggtatcatcacctctaaaaccaaatctctggacaaaggttacaacaaagctctgaacgacctgtgcatcaaagttaacaactgggacctgttcttctctccgtctgaagacaacttcaccaacgacctgaacaaaggtgaagaaatcacctctgacaccaacatcgaagctgctgaagaaaacatctctctggacctgatccagcagtactacctgaccttcaacttcgacaacgaaccggaaaacatctctatcgaaaacctgtcttctgacatcatcggtcagctggaactgatgccgaacatcgaacgtttcccgaacggtaaaaaatacgaactggacaaatacaccatgttccactacctgcgtgctcaggaattcgaacacggtaaatctcgtatcgctctgaccaactctgttaacgaagctctgctgaacccgtctcgtgtttacaccttcttctcttctgactacgttaaaaaagttaacaaagctaccgaagctgctatgttcctgggttgggttgaacagctggtttacgacttcaccgacgaaacctctgaagtttctaccaccgacaaaatcgctgacatcaccatcatcatcccgtacatcggtccggctctgaacatcggtaacatgctgtacaaagacgacttcgttggtgctctgatcttctctggtgctgttatcctgctggaattcatcccggaaatcgctatcccggttctgggtaccttcgctctggtttcttacatcgctaacaaagttctgaccgttcagaccatcgacaacgctctgtctaaacgtaacgaaaaatgggacgaagtttacaaatacatcgttaccaactggctggctaaagttaacacccagatcgacctgatccgtaaaaaaatgaaagaagctctggaaaaccaggctgaagctaccaaagctatcatcaactaccagtacaaccagtacaccgaagaagaaaaaaacaacatcaacttcaacatcgacgacctgtcttctaaactgaacgaatctatcaacaaagctatgatcaacatcaacaaattcctgaaccagtgctctgtttcttacctgatgaactctatgatcccgtacggtgttaaacgtctggaagacttcgacgcttctctgaaagacgctctgctgaaatacatctacgacaaccgtggtaccctgatcggtcaggttgaccgtctgaaagacaaagttaacaacaccctgtctaccgacatcccgttccagctgtctaaatacgttgacaaccagcgtctgctgtctaccttcaccgaatacatcaaaatcctgtcttctggtgacgtttactctggtggttctccgggtgctgttgaaaccatctctttctctttctctgaattcgaaccgggtaacaacgacctgaccctgcagggtgctgctatcatcacccagtctggtgttctgcagctgaccaaaatcaaccagaacggtatgccggcttgggactctaccggtcgtaccctgtacaccaaaccggttcacatctgggacatgaccaccggtaccgttgcttctttcgaaacccgtttctctttctctatcgaacagccgtacacccgtccgctgccggctgacggtctggttttcttcatgggtccgaccaaatctaaaccggctcagggttacggttacctgggtgttttcaacaactctaaacaggacaactcttaccagaccctggctgttgaattcgacaccttctctaacccgtgggacccgccgcaggttccgcacatcggtatcgacgttaactctatccgttctatcaaaacccagccgttccagctggacaacggtcaggttgctaacgttgttatcaaatacgacgcttcttctaaaatcctgctggctgttctggtttacccgtcttctggtgctatctacaccatcgctgaaatcgttgacgttaaacaggttctgccggaatgggttgacgttggtctgtctggtgctaccggtgctcagcgtgacgctgctgaaacccacgacgtttactcttggtctttccacgcttctctgccggaaaccaactga

SEQ ID NO: 139 - protein, 1130 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDDDDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKILSSGDVYSGGSPGAVETISFSFSEFEPGNNDLTLQGAAIITQSGVLQLTKINQNGMPAWDSTGRTLYTKPVHIWDMTTGTVASFETRFSFSIEQPYTRPLPADGLVFFMGPTKSKPAQGYGYLGVFNNSKQDNSYQTLAVEFDTFSNPWDPPQVPHIGIDVNSIRSIKTQPFQLDNGQVANVVIKYDASSKILLAVLVYPSSGAIYTIAEIVDVKQVLPEWVDVGLSGATGAQRDAAETHDVYSWSFHASLPETN

SEQ ID NO: 140 - DNA, 3948 bp, Clostridium tetani
atgccaataaccataaataattttagatatagtgatcctgttaataatgatacaattattatgatggagccaccatactgtaagggtctagatatctattataaggctttcaaaataacagatcgtatttggatagtgccggaaaggtatgaatttgggacaaaacctgaagattttaacccaccatcttcattaatagaaggtgcatctgagtattacgatccaaattatttaaggactgattctgataaagatagatttttacaaaccatggtaaaactgtttaacagaattaaaaacaatgtagcaggtgaagccttattagataagataataaatgccataccttaccttggaaattcatattccttactagacaagtttgatacaaactctaattcagtatcttttaatttattagaacaagaccccagtggagcaactacaaaatcagcaatgctgacaaatttaataatatttggacctgggcctgttttaaataaaaatgaggttagaggtattgtattgagggtagataataaaaattacttcccatgtagagatggttttggctcaataatgcaaatggcattttgcccagaatatgtacctacctttgataatgtaatagaaaatattacgtcactcactattggcaaaagcaaatattttcaagatccagcattactattaatgcacgaacttatacatgtactacatggtttatacggaatgcaggtatcaagccatgaaattattccatccaaacaagaaatttatatgcagcatacatatccaataagtgctgaagaactattcacttttggcggacaggatgctaatcttataagtattgatataaaaaacgatttatatgaaaaaactttaaatgattataaagctatagctaacaaacttagtcaagtcactagctgcaatgatcccaacattgatattgatagctacaaacaaatatatcaacaaaaatatcaattcgataaagatagcaatggacaatatattgtaaatgaggataaatttcagatactatataatagcataatgtatggttttacagagattgaattgggaaaaaaatttaatataaaaactagactttcttattttagtatgaatcatgaccctgtaaaaattccaaatttattagatgatacaatttacaatgatacagaaggatttaatatagaaagcaaagatctgaaatctgaatataaaggacaaaatatgagggtaaatacaaatgcttttagaaatgttgatggatcaggcctagtttcaaaacttattggcttatgtaaaaaaattataccaccaacaaatataagagaaaatttatataatagaactgcatcattaacagatttaggaggagaattatgtataaaaattaaaaatgaagatttaacttttatagctgaaaaaaatagcttttcagaagaaccatttcaagatgaaatagttagttataatacaaaaaataaaccattaaattttaattattcgctagataaaattattgtagattataatctacaaagtaaaattacattacctaatgataggacaaccccagttacaaaaggaattccatatgctccagaatataaaagtaatgctgcaagtacaatagaaatacataatattgatgacaatacaatatatcaatatttgtatgctcaaaaatctcctacaactctacaaagaataactatgactaattctgttgatgacgcattaataaattccaccaaaatatattcatattttccatctgtaatcagtaaagttaaccaaggtgcacaaggaattttattcttacagtgggtgagagatataattgatgattttaccaatgaatcttcacaaaaaactactattgataaaatttcagatgtatccactattgttccttatataggacccgcattaaacattgtaaaacaaggctatgagggaaactttataggcgctttagaaactaccggagtggttttattattagaatatattccagaaattactttaccagtaattgcagctttatctatagcagaaagtagcacacaaaaagaaaagataataaaaacaatagataactttttagaaaaaagatatgaaaaatggattgaagtatataaactagtaaaagcaaaatggttaggcacagttaatacgcaattccaaaaaagaagttatcaaatgtatagatctttagaatatcaagtagatgcaataaaaaaaataatagactatgaatataaaatatattcaggacctgataaggaacaaattgccgacgaaattaataatctgaaaaacaaacttgaagaaaaggctaataaagcaatgataaacataaatatatttatgagggaaagttctagatcatttttagttaatcaaatgattaacgaagctaaaaagcagttattagagtttgatactcaaagcaaaaatattttaatgcagtatataaaagcaaattctaaatttataggtataactgaactaaaaaaattagaatcaaaaataaacaaagttttttcaacaccaattccattttcttattctaaaaatctggattgttgggttgataatgaagaagatatagatgttatattaaaaaagagtacaattttaaatttagatattaataatgatattatatcagatatatctgggtttaattcatctgtaataacatatccagatgctcaattggtgcccggaataaatggcaaagcaatacatttagtaaacaatgaatcttctgaagttatagtgcataaagctatggatattgaatataatgatatgtttaataattttaccgttagcttttggttgagggttcctaaagtatctgctagtcatttagaacaatatggcacaaatgagtattcaataattagctctatgaaaaaacatagtctatcaataggatctggttggagtgtatcacttaaaggtaataacttaatatggactttaaaagattccgcgggagaagttagacaaataacttttagggatttacctgataaatttaatgcttatttagcaaataaatgggtttttataactattactaatgatagattatcttctgctaatttgtatataaatggagtacttatgggaagtgcagaaattactggtttaggagctattagagaggataataatataacattaaaactagatagatgtaataataataatcaatacgtttctattgataaatttaggatattttgcaaagcattaaatccaaaagagattgaaaaattatacacaagttatttatctataacctttttaagagacttctggggaaaccctttacgatatgatacagaatattatttaataccagtagcttctagttctaaagatgttcaattgaaaaatataacagattatatgtatttgacaaatgcgccatcgtatactaacggaaaattgaatatatattatagaaggttatataatggactaaaatttattataaaaagatatacacctaataatgaaatagattcttttgttaaatcaggtgattttattaaattatatgtatcatataacaataatgagcacattgtaggttatccgaaagatggaaatgcctttaataatcttgatagaattctaagagtaggttataatgccccaggtatccctctttataaaaaaatggaagcagtaaaattgcgtgatttaaaaacctattctgtacaacttaaattatatgatgataaaaatgcatctttaggactagtaggtacccataatggtcaaataggcaacgatccaaatagggatatattaattgcaagcaactggtactttaatcatttaaaagataaaattttaggatgtgattggtactttgtacctacagatgaaggatggacaaatgattaa

SEQ ID NO: 141 - protein, 1315 aa, Clostridium tetani
MPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCKKIIPPTNIRENLYNRTASLTDLGGELCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 142 - DNA, 2637 bp, Clostridium tetani
atgccaataaccataaataattttagatatagtgatcctgttaataatgatacaattattatgatggagccaccatactgtaagggtctagatatctattataaggctttcaaaataacagatcgtatttggatagtgccggaaaggtatgaatttgggacaaaacctgaagattttaacccaccatcttcattaatagaaggtgcatctgagtattacgatccaaattatttaaggactgattctgataaagatagatttttacaaaccatggtaaaactgtttaacagaattaaaaacaatgtagcaggtgaagccttattagataagataataaatgccataccttaccttggaaattcatattccttactagacaagtttgatacaaactctaattcagtatcttttaatttattagaacaagaccccagtggagcaactacaaaatcagcaatgctgacaaatttaataatatttggacctgggcctgttttaaataaaaatgaggttagaggtattgtattgagggtagataataaaaattacttcccatgtagagatggttttggctcaataatgcaaatggcattttgcccagaatatgtacctacctttgataatgtaatagaaaatattacgtcactcactattggcaaaagcaaatattttcaagatccagcattactattaatgcacgaacttatacatgtactacatggtttatacggaatgcaggtatcaagccatgaaattattccatccaaacaagaaatttatatgcagcatacatatccaataagtgctgaagaactattcacttttggcggacaggatgctaatcttataagtattgatataaaaaacgatttatatgaaaaaactttaaatgattataaagctatagctaacaaacttagtcaagtcactagctgcaatgatcccaacattgatattgatagctacaaacaaatatatcaacaaaaatatcaattcgataaagatagcaatggacaatatattgtaaatgaggataaatttcagatactatataatagcataatgtatggttttacagagattgaattgggaaaaaaatttaatataaaaactagactttcttattttagtatgaatcatgaccctgtaaaaattccaaatttattagatgatacaatttacaatgatacagaaggatttaatatagaaagcaaagatctgaaatctgaatataaaggacaaaatatgagggtaaatacaaatgcttttagaaatgttgatggatcaggcctagtttcaaaacttattggcttatgtaaaaaaattataccaccaacaaatataagagaaaatttatataatagaactgcatcattaacagatttaggaggagaattatgtataaaaattaaaaatgaagatttaacttttatagctgaaaaaaatagcttttcagaagaaccatttcaagatgaaatagttagttataatacaaaaaataaaccattaaattttaattattcgctagataaaattattgtagattataatctacaaagtaaaattacattacctaatgataggacaaccccagttacaaaaggaattccatatgctccagaatataaaagtaatgctgcaagtacaatagaaatacataatattgatgacaatacaatatatcaatatttgtatgctcaaaaatctcctacaactctacaaagaataactatgactaattctgttgatgacgcattaataaattccaccaaaatatattcatattttccatctgtaatcagtaaagttaaccaaggtgcacaaggaattttattcttacagtgggtgagagatataattgatgattttaccaatgaatcttcacaaaaaactactattgataaaatttcagatgtatccactattgttccttatataggacccgcattaaacattgtaaaacaaggctatgagggaaactttataggcgctttagaaactaccggagtggttttattattagaatatattccagaaattactttaccagtaattgcagctttatctatagcagaaagtagcacacaaaaagaaaagataataaaaacaatagataactttttagaaaaaagatatgaaaaatggattgaagtatataaactagtaaaagcaaaatggttaggcacagttaatacgcaattccaaaaaagaagttatcaaatgtatagatctttagaatatcaagtagatgcaataaaaaaaataatagactatgaatataaaatatattcaggacctgataaggaacaaattgccgacgaaattaataatctgaaaaacaaacttgaagaaaaggctaataaagcaatgataaacataaatatatttatgagggaaagttctagatcatttttagttaatcaaatgattaacgaagctaaaaagcagttattagagtttgatactcaaagcaaaaatattttaatgcagtatataaaagcaaattctaaatttataggtataactgaactaaaaaaattagaatcaaaaataaacaaagttttttcaacaccaattccattttcttattctaaaaatctggattgttgggttgataatgaagaagatatagatgtt

SEQ ID NO: 143 - protein, 879 aa, Clostridium tetani
MPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCKKIIPPTNIRENLYNRTASLTDLGGELCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDV

SEQ ID NO: 144 - DNA, 2616 bp, Clostridium tetani
atgccaataaccataaataattttagatatagtgatcctgttaataatgatacaattattatgatggagccaccatactgtaagggtctagatatctattataaggctttcaaaataacagatcgtatttggatagtgccggaaaggtatgaatttgggacaaaacctgaagattttaacccaccatcttcattaatagaaggtgcatctgagtattacgatccaaattatttaaggactgattctgataaagatagatttttacaaaccatggtaaaactgtttaacagaattaaaaacaatgtagcaggtgaagccttattagataagataataaatgccataccttaccttggaaattcatattccttactagacaagtttgatacaaactctaattcagtatcttttaatttattagaacaagaccccagtggagcaactacaaaatcagcaatgctgacaaatttaataatatttggacctgggcctgttttaaataaaaatgaggttagaggtattgtattgagggtagataataaaaattacttcccatgtagagatggttttggctcaataatgcaaatggcattttgcccagaatatgtacctacctttgataatgtaatagaaaatattacgtcactcactattggcaaaagcaaatattttcaagatccagcattactattaatgcacgaacttatacatgtactacatggtttatacggaatgcaggtatcaagccatgaaattattccatccaaacaagaaatttatatgcagcatacatatccaataagtgctgaagaactattcacttttggcggacaggatgctaatcttataagtattgatataaaaaacgatttatatgaaaaaactttaaatgattataaagctatagctaacaaacttagtcaagtcactagctgcaatgatcccaacattgatattgatagctacaaacaaatatatcaacaaaaatatcaattcgataaagatagcaatggacaatatattgtaaatgaggataaatttcagatactatataatagcataatgtatggttttacagagattgaattgggaaaaaaatttaatataaaaactagactttcttattttagtatgaatcatgaccctgtaaaaattccaaatttattagatgatacaatttacaatgatacagaaggatttaatatagaaagcaaagatctgaaatctgaatataaaggacaaaatatgagggtaaatacaaatgcttttagaaatgttgatggatcaggcctagtttcaaaacttattggcttatgtaaatctgaagaaaagctttacgacgacgacgacaaagaccgttggggttcttcgcgtatctgtataaaaattaaaaatgaagatttaacttttatagctgaaaaaaatagcttttcagaagaaccatttcaagatgaaatagttagttataatacaaaaaataaaccattaaattttaattattcgctagataaaattattgtagattataatctacaaagtaaaattacattacctaatgataggacaaccccagttacaaaaggaattccatatgctccagaatataaaagtaatgctgcaagtacaatagaaatacataatattgatgacaatacaatatatcaatatttgtatgctcaaaaatctcctacaactctacaaagaataactatgactaattctgttgatgacgcattaataaattccaccaaaatatattcatattttccatctgtaatcagtaaagttaaccaaggtgcacaaggaattttattcttacagtgggtgagagatataattgatgattttaccaatgaatcttcacaaaaaactactattgataaaatttcagatgtatccactattgttccttatataggacccgcattaaacattgtaaaacaaggctatgagggaaactttataggcgctttagaaactaccggagtggttttattattagaatatattccagaaattactttaccagtaattgcagctttatctatagcagaaagtagcacacaaaaagaaaagataataaaaacaatagataactttttagaaaaaagatatgaaaaatggattgaagtatataaactagtaaaagcaaaatggttaggcacagttaatacgcaattccaaaaaagaagttatcaaatgtatagatctttagaatatcaagtagatgcaataaaaaaaataatagactatgaatataaaatatattcaggacctgataaggaacaaattgccgacgaaattaataatctgaaaaacaaacttgaagaaaaggctaataaagcaatgataaacataaatatatttatgagggaaagttctagatcatttttagttaatcaaatgattaacgaagctaaaaagcagttattagagtttgatactcaaagcaaaaatattttaatgcagtatataaaagcaaattctaaatttataggtataactgaactaaaaaaattagaatcaaaaataaacaaagttttttcaacaccaattccattttcttattctaaaaatctggattgttgggttgataatgaagaagatatagatgtt

SEQ ID NO: 145 - protein, 872 aa, Clostridium tetani
MPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCKSEEKLYDDDDKDRWGSSRICIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDV

SEQ ID NO: 146 - DNA, 2661 bp, Clostridium tetani
atgccaataaccataaataattttagatatagtgatcctgttaataatgatacaattattatgatggagccaccatactgtaagggtctagatatctattataaggctttcaaaataacagatcgtatttggatagtgccggaaaggtatgaatttgggacaaaacctgaagattttaacccaccatcttcattaatagaaggtgcatctgagtattacgatccaaattatttaaggactgattctgataaagatagatttttacaaaccatggtaaaactgtttaacagaattaaaaacaatgtagcaggtgaagccttattagataagataataaatgccataccttaccttggaaattcatattccttactagacaagtttgatacaaactctaattcagtatcttttaatttattagaacaagaccccagtggagcaactacaaaatcagcaatgctgacaaatttaataatatttggacctgggcctgttttaaataaaaatgaggttagaggtattgtattgagggtagataataaaaattacttcccatgtagagatggttttggctcaataatgcaaatggcattttgcccagaatatgtacctacctttgataatgtaatagaaaatattacgtcactcactattggcaaaagcaaatattttcaagatccagcattactattaatgcacgaacttatacatgtactacatggtttatacggaatgcaggtatcaagccatgaaattattccatccaaacaagaaatttatatgcagcatacatatccaataagtgctgaagaactattcacttttggcggacaggatgctaatcttataagtattgatataaaaaacgatttatatgaaaaaactttaaatgattataaagctatagctaacaaacttagtcaagtcactagctgcaatgatcccaacattgatattgatagctacaaacaaatatatcaacaaaaatatcaattcgataaagatagcaatggacaatatattgtaaatgaggataaatttcagatactatataatagcataatgtatggttttacagagattgaattgggaaaaaaatttaatataaaaactagactttcttattttagtatgaatcatgaccctgtaaaaattccaaatttattagatgatacaatttacaatgatacagaaggatttaatatagaaagcaaagatctgaaatctgaatataaaggacaaaatatgagggtaaatacaaatgcttttagaaatgttgatggatcaggcctagtttcaaaacttattggcttatgtaaaaaaattataccaccaacaaatataagagaaaatttatataatagaactgcatcattaacagatttaggaggagaattatgtataaaaattaaaaatgaagatttaacttttatagctgaaaaaaatagcttttcagaagaaccatttcaagatgaaatagttagttataatacaaaaaataaaccattaaattttaattattcgctagataaaattattgtagattataatctacaaagtaaaattacattacctaatgataggacaaccccagttacaaaaggaattccatatgctccagaatataaaagtaatgctgcaagtacaatagaaatacataatattgatgacaatacaatatatcaatatttgtatgctcaaaaatctcctacaactctacaaagaataactatgactaattctgttgatgacgcattaataaattccaccaaaatatattcatattttccatctgtaatcagtaaagttaaccaaggtgcacaaggaattttattcttacagtgggtgagagatataattgatgattttaccaatgaatcttcacaaaaaactactattgataaaatttcagatgtatccactattgttccttatataggacccgcattaaacattgtaaaacaaggctatgagggaaactttataggcgctttagaaactaccggagtggttttattattagaatatattccagaaattactttaccagtaattgcagctttatctatagcagaaagtagcacacaaaaagaaaagataataaaaacaatagataactttttagaaaaaagatatgaaaaatggattgaagtatataaactagtaaaagcaaaatggttaggcacagttaatacgcaattccaaaaaagaagttatcaaatgtatagatctttagaatatcaagtagatgcaataaaaaaaataatagactatgaatataaaatatattcaggacctgataaggaacaaattgccgacgaaattaataatctgaaaaacaaacttgaagaaaaggctaataaagcaatgataaacataaatatatttatgagggaaagttctagatcatttttagttaatcaaatgattaacgaagctaaaaagcagttattagagtttgatactcaaagcaaaaatattttaatgcagtatataaaagcaaattctaaatttataggtataactgaactaaaaaaattagaatcaaaaataaacaaagttttttcaacaccaattccattttcttattctaaaaatctggattgttgggttgataatgaagaagatatagatgttatattaaaaaagagtacaatttta

SEQ ID NO: 147 - protein, 887 aa, Clostridium tetani
MPITINNFRYSDPVNNDTIIMMEPPYCKGLDIYYKAFKITDRIWIVPERYEFGTKPEDFNPPSSLIEGASEYYDPNYLRTDSDKDRFLQTMVKLFNRIKNNVAGEALLDKIINAIPYLGNSYSLLDKFDTNSNSVSFNLLEQDPSGATTKSAMLTNLIIFGPGPVLNKNEVRGIVLRVDNKNYFPCRDGFGSIMQMAFCPEYVPTFDNVIENITSLTIGKSKYFQDPALLLMHELIHVLHGLYGMQVSSHEIIPSKQEIYMQHTYPISAEELFTFGGQDANLISIDIKNDLYEKTLNDYKAIANKLSQVTSCNDPNIDIDSYKQIYQQKYQFDKDSNGQYIVNEDKFQILYNSIMYGFTEIELGKKFNIKTRLSYFSMNHDPVKIPNLLDDTIYNDTEGFNIESKDLKSEYKGQNMRVNTNAFRNVDGSGLVSKLIGLCKKIIPPTNIRENLYNRTASLTDLGGELCIKIKNEDLTFIAEKNSFSEEPFQDEIVSYNTKNKPLNFNYSLDKIIVDYNLQSKITLPNDRTTPVTKGIPYAPEYKSNAASTIEIHNIDDNTIYQYLYAQKSPTTLQRITMTNSVDDALINSTKIYSYFPSVISKVNQGAQGILFLQWVRDIIDDFTNESSQKTTIDKISDVSTIVPYIGPALNIVKQGYEGNFIGALETTGVVLLLEYIPEITLPVIAALSIAESSTQKEKIIKTIDNFLEKRYEKWIEVYKLVKAKWLGTVNTQFQKRSYQMYRSLEYQVDAIKKIIDYEYKIYSGPDKEQIADEINNLKNKLEEKANKAMININIFMRESSRSFLVNQMINEAKKQLLEFDTQSKNILMQYIKANSKFIGITELKKLESKINKVFSTPIPFSYSKNLDCWVDNEEDIDVILKKSTIL

SEQ ID NO: 148 - DNA, 2619 bp, Clostridium botulinum
  CDS (1)..(2619)
ggatccatggagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctgatccacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaag

SEQ ID NO: 149 - protein, 873 aa, Clostridium botulinum
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 150 - DNA, 2625 bp, Clostridium botulinum
  CDS (1)..(2625)
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagtaatga

SEQ ID NO: 151 - protein, 873 aa, Clostridium botulinum; identical to SEQ ID NO: 149

SEQ ID NO: 152 - DNA, 2619 bp, Clostridium botulinum
  CDS (1)..(2619)
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagtaatga

SEQ ID NO: 153 - protein, 871 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 154 - DNA, 2613 bp, Clostridium botulinum
  CDS (1)..(2613)
atggagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctcatctacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaag

SEQ ID NO: 155 - protein, 871 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIYAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 156 - DNA, 2637 bp, Clostridium botulinum
  CDS (1)..(2637)
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaaatcgaaggtcgtgcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagtaatga

SEQ ID NO: 157 - protein, 877 aa, Clostridium botulinum
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKIEGRALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 158 - DNA, 2643 bp, Clostridium botulinum
  CDS (1)..(2643)
atggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagctcgagcaccaccaccaccaccactaatga

SEQ ID NO: 159 - protein, 879 aa, Clostridium botulinum
MEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKLEHHHHHH

SEQ ID NO: 160 - DNA, 2667 bp, Clostridium botulinum
  CDS (1)..(2667)
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcatcgaaggtcgtgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagatcgaaggtcgtcaccaccaccaccaccactaatga

SEQ ID NO: 161 - protein, 887 aa, Clostridium botulinum
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKASKVVLNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIKIEGRHHHHHH

SEQ ID NO: 162 - DNA, 2625 bp, Clostridium botulinum
  CDS (1)..(2625)
ggatccatggagttcgtgaacaagcagttcaactataaggaccctgtaaacggtgttgacattgcctacatcaaaattccaaacgccggccagatgcagccggtgaaggctttcaagattcataacaaaatctgggttattccggaacgcgatacatttacgaacccggaagaaggagacttgaacccgccgccggaagcaaagcaggtgccagtttcatactacgattcaacctatctgagcacagacaacgagaaggataactacctgaagggagtgaccaaattattcgagcgtatttattccactgacctgggccgtatgctgctgacctcaatcgtccgcggaatcccattttggggtggcagtaccattgacacggagttgaaggttattgacactaactgcattaacgtgatccaaccagacggtagctacagatctgaagaacttaacctcgtaatcatcgggccctccgcggacattatccagtttgagtgcaagagctttggccacgaagtgttgaacctgacgcgtaacggttacggctctactcagtacattcgtttcagcccagacttcacgttcggtttcgaggagagcctggaggttgataccaacccgctgttgggtgcaggcaagttcgcaactgatccagcggtgaccctggcacacgagctcatctacgccggtcatcgtctgtatggcattgcgattaacccgaaccgcgtgttcaaggttaacaccaacgcctactacgagatgagtggtttagaagtaagcttcgaggaactgcgcacgttcggtggccatgatgcgaagtttatcgacagcttgcaggagaacgagttccgtctgtactactacaacaagtttaaagatattgcaagtacactgaacaaggctaagtccattgtgggtaccactgcttcattacagtatatgaaaaatgtttttaaagagaaatatctcctatctgaagatacatctggaaaattttcggtagataaattaaaatttgataagttatacaaaatgttaacagagatttacacagaggataattttgttaagttttttaaagtacttaacagaaaaacatatttgaattttgataaagccgtatttaagataaatatagtacctaaggtaaattacacaatatatgatggatttaatttaagaaatacaaatttagcagcaaactttaatggtcaaaatacagaaattaataatatgaattttactaaactaaaaaattttactggattgtttgaattttataagttgctatgtgtaagagggataataacttctaaaactaaatcattagataaaggatacaataaggcattaaatgatttatgtatcaaagttaataattgggacttgttttttagtccttcagaagataattttactaatgatctaaataaaggagaagaaattacatctgatactaatatagaagcagcagaagaaaatattagtttagatttaatacaacaatattatttaacctttaattttgataatgaacctgaaaatatttcaatagaaaatctttcaagtgacattataggccaattagaacttatgcctaatatagaaagatttcctaatggaaaaaagtatgagttagataaatatactatgttccattatcttcgtgctcaagaatttgaacatggtaaatctaggattgctttaacaaattctgttaacgaagcattattaaatcctagtcgtgtttatacatttttttcttcagactatgtaaagaaagttaataaagctacggaggcagctatgtttttaggctgggtagaacaattagtatatgattttaccgatgaaactagcgaagtaagtactacggataaaattgcggatataactataattattccatatataggacctgctttaaatataggtaatatgttatataaagatgattttgtaggtgctttaatattttcaggagctgttattctgttagaatttataccagagattgcaatacctgtattaggtacttttgcacttgtatcatatattgcgaataaggttctaaccgttcaaacaatagataatgctttaagtaaaagaaatgaaaaatgggatgaggtctataaatatatagtaacaaattggttagcaaaggttaatacacagattgatctaataagaaaaaaaatgaaagaagctttagaaaatcaagcagaagcaacaaaggctataataaactatcagtataatcaatatactgaggaagagaaaaataatattaattttaatattgatgatttaagttcgaaacttaatgagtctataaataaagctatgattaatataaataaatttttgaatcaatgctctgtttcatatttaatgaattctatgatcccttatggtgttaaacggttagaagattttgatgctagtcttaaagatgcattattaaagtatatatatgataatagaggaactttaattggtcaagtagatagattaaaagataaagttaataatacacttagtacagatataccttttcagctttccaaatacgtagataatcaaagattattatctacatttactgaatatattaagtaatga

SEQ ID NO: 163 - protein, 873 aa, Clostridium botulinum
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHELIYAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 164 - DNA, 2625 bp, Clostridium botulinum
  CDS (1)..(2625)
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcacgaactgatttatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagtaatga

SEQ ID NO: 165 - protein, 873 aa, Clostridium botulinum; identical to SEQ ID NO: 163

SEQ ID NO: 166 - DNA, 2625 bp, Clostridium botulinum
  CDS (1)..(2625)
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcaccagctgattcatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagtaatga

SEQ ID NO: 167 - protein, 873 aa, Clostridium botulinum
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHQLIHAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 168 - DNA, 2625 bp, Clostridium botulinum
  CDS (1)..(2625)
ggatccatggagttcgttaacaaacagttcaactataaagacccagttaacggtgttgacattgcttacatcaaaatcccgaacgctggccagatgcagccggtaaaggcattcaaaatccacaacaaaatctgggttatcccggaacgtgatacctttactaacccggaagaaggtgacctgaacccgccaccggaagcgaaacaggtgccggtatcttactatgactccacctacctgtctaccgataacgaaaaggacaactacctgaaaggtgttactaaactgttcgagcgtatttactccaccgacctgggccgtatgctgctgactagcatcgttcgcggtatcccgttctggggcggttctaccatcgataccgaactgaaagtaatcgacactaactgcatcaacgttattcagccggacggttcctatcgttccgaagaactgaacctggtgatcatcggcccgtctgctgatatcatccagttcgagtgtaagagctttggtcacgaagttctgaacctcacccgtaacggctacggttccactcagtacatccgtttctctccggacttcaccttcggttttgaagaatccctggaagtagacacgaacccactgctgggcgctggtaaattcgcaactgatcctgcggttaccctggctcaccagctgatttatgcaggccaccgcctgtacggtatcgccatcaatccgaaccgtgtcttcaaagttaacaccaacgcgtattacgagatgtccggtctggaagtaagcttcgaagaactgcgtacttttggcggtcacgacgctaaattcatcgactctctgcaagaaaacgagttccgtctgtactactataacaagttcaaagatatcgcatccaccctgaacaaagcgaaatccatcgtgggtaccactgcttctctgcagtacatgaagaacgtttttaaagaaaaatacctgctcagcgaagacacctccggcaaattctctgtagacaagttgaaattcgataaactttacaaaatgctgactgaaatttacaccgaagacaacttcgttaagttctttaaagttctgaaccgcaaaacctatctgaacttcgacaaggcagtattcaaaatcaacatcgtgccgaaagttaactacactatctacgatggtttcaacctgcgtaacaccaacctggctgctaattttaacggccagaacacggaaatcaacaacatgaacttcacaaaactgaaaaacttcactggtctgttcgagttttacaagctgctgtgcgtacgtggcatcattacctccaaaactaaatctctggacaaaggttataacaaagcgctgaacgacctctgtatcaaggttaacaactgggatttattcttcagcccgagtgaagacaacttcaccaacgacctgaacaaaggtgaagaaatcacctcagatactaacatcgaagcagccgaagaaaacatctcgctggacctgatccagcagtactacctgacctttaatttcgacaacgagccggaaaacatttctatcgaaaacctgagctctgatatcatcggccagctggaactgatgccgaacatcgaacgtttcccaaacggtaaaaagtacgagctggacaaatataccatgttccactacctgcgcgcgcaggaatttgaacacggcaaatcccgtatcgcactgactaactccgttaacgaagctctgctcaacccgtcccgtgtatacaccttcttctctagcgactacgtgaaaaaggtcaacaaagcgactgaagctgcaatgttcttgggttgggttgaacagcttgtttatgattttaccgacgagacgtccgaagtatctactaccgacaaaattgcggatatcactatcatcatcccgtacatcggtccggctctgaacattggcaacatgctgtacaaagacgacttcgttggtgcactgatcttctccggtgcggtgatcctgctggagttcatcccggaaatcgccatcccggtactgggcacctttgctctggtttcttacattgcaaacaaggttctgactgtacaaaccatcgacaacgcgctgagcaaacgtaacgaaaaatgggatgaagtttacaaatatatcgtgaccaactggctggctaaggttaatactcagatcgacctcatccgcaaaaaaatgaaagaagcactggaaaaccaggcggaagctaccaaggcaatcattaactaccagtacaaccagtacaccgaggaagaaaaaaacaacatcaacttcaacatcgacgatctgtcctctaaactgaacgaatccatcaacaaagctatgatcaacatcaacaagttcctgaaccagtgctctgtaagctatctgatgaactccatgatcccgtacggtgttaaacgtctggaggacttcgatgcgtctctgaaagacgccctgctgaaatacatttacgacaaccgtggcactctgatcggtcaggttgatcgtctgaaggacaaagtgaacaataccttatcgaccgacatcccttttcagctcagtaaatatgtcgataaccaacgccttttgagcacgttcacagagtacatcaagtaatga

SEQ ID NO: 169 - protein, 873 aa, Clostridium botulinum
GSMEFVNKQFNYKDPVNGVDIAYIKIPNAGQMQPVKAFKIHNKIWVIPERDTFTNPEEGDLNPPPEAKQVPVSYYDSTYLSTDNEKDNYLKGVTKLFERIYSTDLGRMLLTSIVRGIPFWGGSTIDTELKVIDTNCINVIQPDGSYRSEELNLVIIGPSADIIQFECKSFGHEVLNLTRNGYGSTQYIRFSPDFTFGFEESLEVDTNPLLGAGKFATDPAVTLAHQLIYAGHRLYGIAINPNRVFKVNTNAYYEMSGLEVSFEELRTFGGHDAKFIDSLQENEFRLYYYNKFKDIASTLNKAKSIVGTTASLQYMKNVFKEKYLLSEDTSGKFSVDKLKFDKLYKMLTEIYTEDNFVKFFKVLNRKTYLNFDKAVFKINIVPKVNYTIYDGFNLRNTNLAANFNGQNTEINNMNFTKLKNFTGLFEFYKLLCVRGIITSKTKSLDKGYNKALNDLCIKVNNWDLFFSPSEDNFTNDLNKGEEITSDTNIEAAEENISLDLIQQYYLTFNFDNEPENISIENLSSDIIGQLELMPNIERFPNGKKYELDKYTMFHYLRAQEFEHGKSRIALTNSVNEALLNPSRVYTFFSSDYVKKVNKATEAAMFLGWVEQLVYDFTDETSEVSTTDKIADITIIIPYIGPALNIGNMLYKDDFVGALIFSGAVILLEFIPEIAIPVLGTFALVSYIANKVLTVQTIDNALSKRNEKWDEVYKYIVTNWLAKVNTQIDLIRKKMKEALENQAEATKAIINYQYNQYTEEEKNNINFNIDDLSSKLNESINKAMININKFLNQCSVSYLMNSMIPYGVKRLEDFDASLKDALLKYIYDNRGTLIGQVDRLKDKVNNTLSTDIPFQLSKYVDNQRLLSTFTEYIK

SEQ ID NO: 170 - DNA, 2592 bp, Clostridium botulinum
  CDS (1)..(2592)
atgccggttaccatcaacaacttcaactacaacgacccgatcgacaacaacaacatcatcatgatggaaccgccgttcgcacgtggtaccggtcgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgatcaaactcttcaaccgtatcaaaagcaaaccgctcggtgaaaaactcctcgaaatgattatcaacggtatcccgtacctcggtgaccgtcgtgtcccgctcgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagcgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgatgcagcgctccgggtatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagctaatag

SEQ ID NO: 171 - protein, 862 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRCSAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 172 - DNA, 2592 bp, Clostridium botulinum
  CDS (1)..(2592)
atgccggttaccatcaacaacttcaactacaacgacccgatcgacaacaacaacatcattatgatggaaccgccgttcgcacgtggtaccggtcgttactgcaaggctttcaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattctttcagactatgatcaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgatgcagcgctccgggtatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagctaatag

SEQ ID NO: 173 - protein, 862 aa, Clostridium botulinum
MPVTINNFNYNDPIDNNNIIMMEPPFARGTGRYCKAFKITDRIWIIPERYTFGYKPEDFNKSSGIFNRDVCEYYDPDYLNTNDKKNIFFQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRCSAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 174 - DNA, 2586 bp, Clostridium botulinum
  CDS (1)..(2586)
atgccggttaccatcaacaacttcaactacaacgacccgatcgacaacaacaacatcattatgatggaaccgccgttcgcacgtggtaccggacgttactacaaggcttttaagatcaccgaccgtatctggatcatcccggaacgttacaccttcggttacaaacctgaggacttcaacaagagtagcgggattttcaatcgtgacgtctgcgagtactatgatccagattatctgaataccaacgataagaagaacatattccttcagactatgattaaactcttcaaccgtatcaaaagcaaaccgctcggtgaaaaactcctcgaaatgattatcaacggtatcccgtacctcggtgaccgtcgtgtcccgcttgaagagttcaacaccaacatcgcaagcgtcaccgtcaacaaactcatcagcaacccaggtgaagtcgaacgtaaaaaaggtatcttcgcaaacctcatcatcttcggtccgggtccggtcctcaacgaaaacgaaaccatcgacatcggtatccagaaccacttcgcaagccgtgaaggtttcggtggtatcatgcagatgaaattctgcccggaatacgtcagtgtcttcaacaacgtccaggaaaacaaaggtgcaagcatcttcaaccgtcgtggttacttcagcgacccggcactcatcctcatgcatgaactcatccacgtcctccacggtctctacggtatcaaagttgacgacctcccgatcgtcccgaacgagaagaaattcttcatgcagagcaccgacgcaatccaggctgaggaactctacaccttcggtggccaagacccaagtatcataaccccgtccaccgacaaaagcatctacgacaaagtcctccagaacttcaggggtatcgtggacagactcaacaaagtcctcgtctgcatcagcgacccgaacatcaatatcaacatatacaagaacaagttcaaagacaagtacaaattcgtcgaggacagcgaaggcaaatacagcatcgacgtagaaagtttcgacaagctctacaaaagcctcatgttcggtttcaccgaaaccaacatcgccgagaactacaagatcaagacaagggcaagttacttcagcgacagcctcccgcctgtcaaaatcaagaacctcttagacaacgagatttacactatagaagagggcttcaacatcagtgacaaagacatggagaaggaatacagaggtcagaacaaggctatcaacaaacaggcatacgaggagatcagcaaagaacacctcgcagtctacaagatccagatgtgtagcgctatcgaaggccgagctcccgggatctgcatcgacgttgacaacgaagacctgttcttcatcgctgacaaaaacagcttcagtgacgacctgagcaaaaacgaacgtatcgaatacaacacccagagcaactacatcgaaaacgacttcccgatcaacgaactgatcctggacaccgacctgataagtaaaatcgaactgccgagcgaaaacaccgaaagtctgaccgacttcaacgttgacgttccggtttacgaaaaacagccggctatcaagaaaatcttcaccgacgaaaacaccatcttccagtacctgtacagccagaccttcccgctggacatccgtgacatcagtctgaccagcagtttcgacgacgctctgctgttcagcaacaaagtttacagtttcttcagcatggactacatcaaaaccgctaacaaagttgttgaagcagggctgttcgctggttgggttaaacagatcgttaacgacttcgttatcgaagctaacaaaagcaacactatggacaaaatcgctgacatcagtctgatcgttccgtacatcggtctggctctgaacgttggtaacgaaaccgctaaaggtaactttgaaaacgctttcgagatcgctggtgcaagcatcctgctggagttcatcccggaactgctgatcccggttgttggtgctttcctgctggaaagttacatcgacaacaaaaacaagatcatcaaaaccatcgacaacgctctgaccaaacgtaacgaaaaatggagtgatatgtacggtctgatcgttgctcagtggctgagcaccgtcaacacccagttctacaccatcaaagaaggtatgtacaaagctctgaactaccaggctcaggctctggaagagatcatcaaataccgttacaacatctacagtgagaaggaaaagagtaacatcaacatcgacttcaacgacatcaacagcaaactgaacgaaggtatcaaccaggctatcgacaacatcaacaacttcatcaacggttgcagtgttagctacctgatgaagaagatgatcccgctggctgttgaaaaactgctggacttcgacaacaccctgaaaaagaacctgctgaactacatcgacgaaaacaagctgtacctgatcggtagtgctgaatacgaaaaaagtaaagtgaacaaatacctgaagaccatcatgccgttcgacctgagtatctacaccaacgacaccatcctgatcgaaatgttcaacaaatacaacagctaatag

SEQ ID NO: 175 - protein, 860 aa, Clostridium botulinum
MPVTINNFNYNDPIDNNNIIMMEPPFARGTGRYYKAFKITDRIWIIPERYTFGYKPEDFNKSSGIFNRDVCEYYDPDYLNTNDKKNIFLQTMIKLFNRIKSKPLGEKLLEMIINGIPYLGDRRVPLEEFNTNIASVTVNKLISNPGEVERKKGIFANLIIFGPGPVLNENETIDIGIQNHFASREGFGGIMQMKFCPEYVSVFNNVQENKGASIFNRRGYFSDPALILMHELIHVLHGLYGIKVDDLPIVPNEKKFFMQSTDAIQAEELYTFGGQDPSIITPSTDKSIYDKVLQNFRGIVDRLNKVLVCISDPNININIYKNKFKDKYKFVEDSEGKYSIDVESFDKLYKSLMFGFTETNIAENYKIKTRASYFSDSLPPVKIKNLLDNEIYTIEEGFNISDKDMEKEYRGQNKAINKQAYEEISKEHLAVYKIQMCSAIEGRAPGICIDVDNEDLFFIADKNSFSDDLSKNERIEYNTQSNYIENDFPINELILDTDLISKIELPSENTESLTDFNVDVPVYEKQPAIKKIFTDENTIFQYLYSQTFPLDIRDISLTSSFDDALLFSNKVYSFFSMDYIKTANKVVEAGLFAGWVKQIVNDFVIEANKSNTMDKIADISLIVPYIGLALNVGNETAKGNFENAFEIAGASILLEFIPELLIPVVGAFLLESYIDNKNKIIKTIDNALTKRNEKWSDMYGLIVAQWLSTVNTQFYTIKEGMYKALNYQAQALEEIIKYRYNIYSEKEKSNINIDFNDINSKLNEGINQAIDNINNFINGCSVSYLMKKMIPLAVEKLLDFDNTLKKNLLNYIDENKLYLIGSAEYEKSKVNKYLKTIMPFDLSIYTNDTILIEMFNKYNS

SEQ ID NO: 176 - protein, 5 aa, artificial sequence
  synthetic peptide
DDDDK

SEQ ID NO: 177 - protein, 4 aa, artificial sequence
  synthetic peptide
IEGR

SEQ ID NO: 178 - protein, 4 aa, artificial sequence
  synthetic peptide
IDGR

SEQ ID NO: 179 - protein, 7 aa, artificial sequence
  synthetic peptide
ENLYFQG

SEQ ID NO: 180 - protein, 6 aa, artificial sequence
  synthetic peptide
LVPRGS

SEQ ID NO: 181 - protein, 8 aa, artificial sequence
  synthetic peptide
LEVLFQGP

SEQ ID NO: 182 - protein, 4 aa, artificial sequence
  synthetic peptide
  2..3: Xaa is any amino acid
RXXR

SEQ ID NO: 183 - protein, 4 aa, artificial sequence
  synthetic peptide
  2: Xaa is any amino acid
RXKR

SEQ ID NO: 184 - protein, 4 aa, artificial sequence
  synthetic peptide
  2: Xaa is any amino acid
RXRR

---

What is claimed is:

1. A method of making an activated di-chain polypeptide, said method comprising:
    (a) providing a single-chain fusion protein comprising
        (i) a clostridial neurotoxin light chain protease, wherein said light chain protease includes the active proteolytic enzyme domain of the light chain and is capable of cleaving one or more vesicle or plasma-membrane associated proteins essential for exocytosis;
        (ii) a clostridial neurotoxin heavy chain $H_N$ portion, wherein said $H_N$ portion is capable of translocating (i) into a mammalian cell; and
        (iii) a protease cleavage site that has been introduced into the single-chain fusion protein;
    (b) contacting the single-chain fusion protein with a protease that cleaves said single-chain fusion protein at the protease cleavage site; and
    (c) cleaving said single-chain fusion protein with said protease, thereby providing an activated di-chain polypeptide wherein (i) and (ii) are linked together by a disulphide bond.

2. A method according to claim 1, wherein the protease is not produced by a naturally-occurring *Clostridium botulinum*.

3. A method according to claim 1, wherein the protease cleavage site is not cleaved by a naturally-occurring *Clostridium botulinum* protease.

4. A method according to claim 1, wherein the protease cleavage site is cleaved by a protease selected from the group consisting of: factor Xa; enterokinase; precission; thrombin; genenase; TEV protease; and furin.

5. A method according to claim 1, wherein the protease is selected from the group consisting of: factor Xa; enterokinase; precission; thrombin; genenase; TEV protease; and furin.

6. A method according to claim 1, wherein the clostridial neurotoxin light chain is a botulinum neurotoxin light chain.

7. A method according to claim 1, wherein the clostridial neurotoxin $H_N$ portion is a botulinum neurotoxin $H_N$ portion.

8. A method according to claim 1, wherein the single-chain fusion protein includes a non-clostridial peptide domain that binds to a target cell.

9. A method according to claim 1, wherein the cleavage site is not present in a naturally-occurring clostridial neurotoxin at any position between the light chain and heavy chain of said naturally-occurring clostridial neurotoxin.

10. A method according to claim 1, wherein the cleavage site comprises the amino acid sequence selected from the group consisting of: IEGR (SEQ ID NO: 177); IDGR (SEQ ID NO: 178); DDDDK (SEQ ID NO: 176); LEVLFQGP (SEQ ID NO: 181); LVPRGS (SEQ ID NO: 180); HY; YH; ENLYFQG (SEQ ID NO: 179); RXXR (SEQ ID NO: 182); RXKR (SEQ ID NO: 183); and RXRR (SEQ ID NO: 184).

11. An activated di-chain polypeptide obtained by the method according to claim 1, comprising:
    (i) a clostridial neurotoxin light chain protease, wherein said light chain protease includes the active proteolytic enzyme domain of the light chain and is capable of cleaving one or more vesicle or plasma-membrane associated proteins essential for exocytosis; and (ii) a clostridial neurotoxin heavy chain $H_N$ portion, wherein said $H_N$ portion is capable of translocating (i) into a mammalian cell; wherein (i) and (ii) are linked together by a disulphide bond.

12. A single chain polypeptide comprising:

(i) a clostridial neurotoxin light chain protease, wherein said light chain protease includes the active proteolytic enzyme domain of the light chain and is capable of cleaving one or more vesicle or plasma-membrane associated proteins essential for exocytosis;

(ii) a clostridial neurotoxin heavy chain $H_N$ portion, wherein said $H_N$ portion is capable of translocating (i) into a mammalian cell; and (iii) a protease cleavage site that has been introduced into the single-chain fusion protein.

13. The single-chain polypeptide according to claim 12, wherein the protease cleavage site is not cleaved by a naturally-occurring *Clostridium botulinum* protease.

14. The single-chain polypeptide according to claim 12, wherein the single-chain polypeptide includes a non-clostridial peptide domain that binds to a target cell.

15. The single-chain polypeptide according to claim 12, wherein the protease cleavage site comprises the amino acid sequence selected from the group consisting of: IEGR (SEQ ID NO: 177); IDGR (SEQ ID NO: 178); DDDDK (SEQ ID NO: 176); LEVLFQGP (SEQ ID NO: 181); LVPRGS (SEQ ID NO: 180); HY; YH; ENLYFQG (SEQ ID NO: 179); RXXR (SEQ ID NO: 182); RXKR (SEQ ID NO: 183); and RXRR (SEQ ID NO: 184).

16. The activated di-chain polypeptide according to claim 11, wherein the protease cleavage site is not cleaved by a naturally-occurring *Clostridium botulinum* protease.

17. The activated di-chain polypeptide according to claim 11, wherein the di-chain polypeptide includes a non-clostridial peptide domain that binds to a target cell.

18. The activated di-chain polypeptide according to claim 11, wherein the protease cleavage site comprises the amino acid sequence selected from the group consisting of: IEGR (SEQ ID NO: 177); IDGR (SEQ ID NO: 178); DDDDK (SEQ ID NO: 176); LEVLFQGP (SEQ ID NO: 181); LVPRGS (SEQ ID NO: 180); HY; YH; ENLYFQG (SEQ ID NO: 179); RXXR (SEQ ID NO: 182); RXKR (SEQ ID NO: 183); and RXRR (SEQ ID NO: 184).

* * * * *